(12) United States Patent
Domon et al.

(10) Patent No.: US 7,473,531 B1
(45) Date of Patent: Jan. 6, 2009

(54) PANCREATIC CANCER TARGETS AND USES THEREOF

(75) Inventors: Bruno Domon, Rockville, MD (US);
Ian McCaffery, Rockville, MD (US);
Vaibhav Narayan, Rockville, MD (US);
Scott Patterson, Newbury Park, CA (US)

(73) Assignee: Colora Corporation, Alameda, CA (US)

( * ) Notice: Subject to any disclaimer, the term of this patent is extended or adjusted under 35 U.S.C. 154(b) by 434 days.

(21) Appl. No.: 10/912,745

(22) Filed: Aug. 6, 2004

Related U.S. Application Data

(60) Provisional application No. 60/552,390, filed on Mar. 12, 2004, provisional application No. 60/519,832, filed on Nov. 14, 2003, provisional application No. 60/512,690, filed on Oct. 21, 2003, provisional application No. 60/493,369, filed on Aug. 8, 2003.

(51) Int. Cl.
*G01N 33/53* (2006.01)

(52) U.S. Cl. .............. 435/7.1; 435/7.23; 530/350; 530/387.1

(58) Field of Classification Search ............... 435/7.1, 435/7.23; 530/350, 387.1
See application file for complete search history.

(56) References Cited

U.S. PATENT DOCUMENTS 6,500,938 B1    12/2002   Au-Young et al.
6,974,667 B2    12/2005   Horne et al.
2004/0005644 A1* 1/2004   Su et al. ............... 435/7.23

FOREIGN PATENT DOCUMENTS

WO        WO 02/30268        4/2002

OTHER PUBLICATIONS

Tockman et al (Cancer Res., 1992, 52:2711s-2718s).*
Schmid S et al, 2001 (J comparative Neurology, 430(2): 160-71).*
Conner et al, 1996 (Mol Brain Res, 42: 1-17).*
MPSRCH search result, 2007, us-10-912-745.56. rapbm, result 1, pp. 1-2.*
Fuchs et al., "Inducible antisense RNA targeting amino acid transporter ATB/ASCT2 . . . " Am J Physiol Gastrointest Liver Physiol; Mar. 2004; G467-G478; 286.
Witte et al., "Overexpression of the Neutral Amino Acid Transporter ASCT2 . . . " Anticancer Research; Mar. 2002; 2555-2558; 22.
Li et al., "Expression of Neutral Amono Acid Transporter ASCT2 . . . " Anticancer Research; May 2003; 3413-3418; 23.

* cited by examiner

*Primary Examiner*—Larry R. Helms
*Assistant Examiner*—Minh-Tam Davis

(57) ABSTRACT

The present invention provides a method for diagnosing and detecting diseases associated with pancreas. The present invention provides one or more proteins or fragments thereof, peptides or nucleic acid molecules differentially expressed in pancreatic diseases (PCAT) and antibodies binds to PCAT. The present invention provides that PCAT is used as targets for screening agents that modulates the PCAT activities. Further, the present invention provides methods for treating diseases associated with pancreas.

3 Claims, 10 Drawing Sheets

Kunitz Inhibitor-1
Expression in Various Tumor Types by IHC

N=10

| | Breast | Colon | Lung, NSC | Prostate | Ovary | Pancreas |
|---|---|---|---|---|---|---|
| | 1 | 1 | 2 (Rare) | 2 | 3 | 1 |
| | 1 | 2 | 2 (Occa) | 1 | 1 (Occa) | 2 |
| | 2 (Occa) | 3 | 2 | 3 | 3 | 1 |
| | 2 | 1 | 3 | 1 | 2 | 3 |
| | 0 | 2 | 1 | 2 | 0 | 2 (Occa) |
| | 2 | 2 | 2 | 3 | 2 (Occa) | 0 |
| | 3 | 0 | 2 | 3 | 2 | 2 |
| | 4 | 2 | 2 | 3 | 3 | 2 |
| | 1 | 1 | 3 | 3 | 2 | 3 |
| | 2 | | 2 | 1 | 1 (Occa) | 2 |

| | Breast | Colon | Lung, NSC | Prostate | Ovary | Pancreas |
|---|---|---|---|---|---|---|
| Normal epithelium | 2 | 3 | 2 | 2 | 0 | 0 to 1 |
| Overexpression Δ+1 (% tumors) | 20 | 0 | 30 | 40 | 90 | 70 |
| Overexpression Δ+2 (% tumors) | 10 | 0 | 0 | 0 | 80 | 20 |

Scale: 0 1 2 3 4

FIGURE 2

Morphology of ASPC-1 Pancreatic Cancer Cells

100nM PA-116 (mucin 4) siRNA

TRAIL + Actinomycin D

LY294002 PI3 Kinase Inhibitor

No Addition

100nM Negative Control siRNA

US 7,473,531 B1

PANCREATIC CANCER TARGETS AND USES THEREOF

This application claims priority under 35 USC .sctn. 119(e) to U.S. Provisional Application No. 60/493,369, filed Aug. 8, 2003; U.S. Provisional Application No. 60/512,690, filed Oct. 21, 2003; U.S. Provisional Application No. 60/519,832, filed Nov. 14, 2003; and U.S. Provisional Application No. 60/552,390, filed Mar. 12, 2004.

FIELD OF THE INVENTION

This invention relates to the fields of molecular biology and oncology. Specifically, the invention provides a molecular marker and a therapeutic agent for use in the diagnosis and treatment of cancers.

BACKGROUND OF THE INVENTION

Cancer currently constitutes the second most common cause of death in the United States. Carcinomas of the pancreas are the eighth most prevalent form of cancer and fourth among the most common causes of cancer deaths in this country.

The prognosis for pancreatic carcinoma is, at present, very poor, it displays the lowest five-year survival rate among all cancers. Such prognosis results primarily from delayed diagnosis, due in part to the fact that the early symptoms are shared with other more common abdominal ailments. Despite the advances in diagnostic imaging methods like ultrasonography (US), endoscopic ultrasonography (EUS), dualphase spiral computer tomography (CT), magnetic resonance imaging (MRT), endoscopic retrograde cholangiopancreatography (ERCP) and transcutaneous or EUS-guided fine-needle aspiration (FNA), distinguishing pancreatic carcinoma from benign pancreatic diseases, especially chronic pancreatitis, is difficult because of the similarities in radiological and imaging features and the lack of specific clinical symptoms for pancreatic carcinoma.

Substantial efforts have been directed to developing tools useful for early diagnosis of pancreatic carcinomas. Nonetheless, a definitive diagnosis is often dependent on exploratory surgery which is inevitably performed after the disease has advanced past the point when early treatment may be effected.

One promising method for early diagnosis of various forms of cancer is the identification of specific biochemical moieties, termed targets, expressed differentially in the cancerous cells. The targets are either cell suface proteins or cytosolic proteins. Antibodies which will specifically recognize and bind to the targets in the cancerous cells potentially provide powerful tools for the diagnosis and treatment of the particular malignancy.

SUMMARY OF THE INVENTION

The present invention is based on the identification of certain cell surface proteins or cytosolic proteins that are differentially expressed in pancreatic disease. A malignant cell often differs from a normal cell by a differential expression of one or more proteins. These differentially expressed proteins, and the fragments thereof, are important markers for the diagnosis of pancreatic disease, as well as other cancers. The differentially expressed proteins of the present invention and the nucleic acids encoding said proteins and the fragments of said proteins are referred to herein as pancreatic cancer associated target, PCAT proteins or PCAT nucleic acids or PCAT peptides, respectively.

The present invention provides peptides and protein differentially expressed in pancreatic diseases (hereinafter PCAT), particularly pancreatic cancer. Based on the site of protein localization, e.g., surface or cytosolic, and protein characterization, e.g. receptor or enzyme, specific uses of these PCATs are provided. Some of the PCATs of the present invention serve as targets for one or more classes of theraputic agents, while others may be suitable for antibody theraputics.

Accordingly, the present invention provides a method for diagnosing or detecting a pancreatic disease in a subject comprising: determining the level of one or more PCAT proteins, or any fragment(s) thereof, in a test sample from said subject, wherein said PCAT protein comprises a sequence selected from a group consisting of SEQ ID NOS: 1-288; wherein a differential level of said PCAT protein(s) or fragment(s) in said sample relative to the level of said protein(s) or fragment(s) in a test sample from a healthy subject, or the level established for a healthy subject, is indicative of pancreatic disease.

The present invention also provides a method for detecting a pancreatic disease in a subject comprising: determining the level of one or more PCAT peptide(s) comprising a peptide sequence selected from a group consisting of SEQ ID NOS: 703-873 in a test sample from said subject, wherein a differential level of said PCAT peptide(s) in said sample to the level of said PCAT peptide(s) in a test sample from a healthy subject, or the level of said PCAT peptide(s) established for a healthy subject, is indicative of the pancreatic disease.

The present invention further provides a method for detecting a pancreatic disease in a subject comprising: determining the level of one or more PCAT nucleic acid(s), or any fragment(s) thereof, in a test sample from said subject, wherein said PCAT nucleic acid(s) encode a PCAT protein sequence selected from a group consisting of SEQ ID NOS: 1-288; wherein a differential level of said PCAT nucleic acids or fragment(s) in said sample relative to the level of said protein(s) or fragment(s) in a test sample from a healthy subject, or the level established for a healthy subject, is indicative of the pancreatic disease.

The invention also provides methods for detecting the PCAT peptides, gene or mRNA in a test sample for use in diagnosing the presence, absence or progression of a disease. The test sample includes but is not limited to a biological sample such as tissue, blood, serum or biological fluid.

The present invention further provides a purified antibody that binds specifically to a protein molecule, or any fragment thereof, selected from a group consisting of SEQ ID NOS: 1-288.

The present invention further provides a composition comprising an antibody that binds to a protein selected from a group consisting of SEQ ID NOS: 1-288, and an acceptable carrier.

The present invention further provides a method for treating a pancreatic disease, comprising administering to a patient in need of said treatment a therapeutically effective amount of one or more antibody(ies) of this invention.

The present invention further provides a method for treating a pancreatic disease comprising (i) identifying a subject having pancreatic disease and (ii) administering to a said patient a therapeutically effective amount of one or more antibody(ies) of this invention.

The present invention further provides a method to screen for agents that modulate PCAT protein activity, comprising the steps of (i) contacting a test agent with a PCAT protein and (ii) assaying for PCAT protein activity, wherein a change in said activity in the presence of said agent relative to PCAT protein activity in the absence of said agent indicates said agent modulates said PCAT protein activity.

The present invention further provides a method to screen for agents that bind to PCAT proteins, comprising the steps of (i) contacting a test agent with a PCAT protein and (ii) measuring the level of binding of agent to said PCAT protein.

The invention also provides diagnostic methods for human disease, in particular for pancreatic cancer, its metastatic stage, and therapeutic potential.

The present invention further provides diagnostic method for epithelial-cell related cancers. In particular, pancreas, lung, colon, prostate, ovarian, breast, bladder renal, hepatocellular, pharyngeal, and gastric cancers.

The invention also provides a method for monitoring the disease progression and the treatment progress.

The invention further provide a method of diagnosis by an array, wherein the array is immobilized with two or more PCAT proteins, peptides or nucleic acid molecules. The proteins, peptides or nucleic acid molecules include but are not limited to the SEQ ID NOS: 1-873.

The invention also provides monoclonal or polyclonal antibodies and composition thereof reactive with antigentic portion of PCAT protein, peptides or fragments thereof in a form for use in pancreatic diseases diagnosis.

The invention further provides an immunogenic antibody for treating pancreatic disease or diseases associated with pancreatic diseases, preferably pancreatic cancer.

The present invention provides a method for screening agents that modulate PCAT activity, comprising the steps of (a) contacting a sample comprising a PCAT with an agent; and (b) assaying for PCAT activity, wherein a change in said PCAT activity in the presence of said agent relative to PCAT activity in the absence of said compound indicates said agent modulates PCAT. The agents include but are not limted to protein, peptide, antibody, nucleic acid such as antisense RNA, RNAi fragments, small molecules.

The present invention further provides a method for treating pancreatic diseases, comprising: administering to a patient one or more agents in a therapeutically effective amount to treat pancreatic diseases.

The present invention provides a method for treating pancreatic diseases, comprising: identifying a subject having pancreatic diseases; and administering to a patient to one or more antibodies in a therapeutically effective amount to treat pancreatic diseases.

The present invention further provide method for diagnosis and treatment for pancreatic cancer.

The present invention further provides therapeutic potential for epithelial-cell related cancers. In particular pancreas, lung, colon, prostate, ovarian, breast, bladder renal, hepatocellular, pharyngeal and gastric cancers.

Description of the Files Contained on the CD-R Named CL001538CDR

The CD-R named CL001538CDR contains the following three text (ASCII) files:

1) File 1538 SEQLIST.txt provides the Sequence Listing. The Sequence Listing provides the protein sequences (SEQ ID NOS: 1-288); transcript sequences (SEQ ID NOS: 289-702) and peptide sequences (SEQ ID NOS: 703-873) as shown in Table 2. File SEQLIST_1538.txt is 3,230 KB in size.

2) File 1538 prov_Applera_Proteomic_IP_table1 is 185 KB in size.

3) File 1538 prov_Applera_Proteomic_IP_table2 is 1984 KB in size.

The material contained on the CD-R labeled CL001538 CDR is hereby incorporated by reference pursuant to 37 CFR 1.77(b)(4).

Description of Table 1 and Table 2

Table 1 (provided on the CD-R) discloses the peptides which correspond to the protein, the pancreatic cancer cell lines, the expression information, the ratio compare to the control sample. The expression is based on measuring the level of the peptides. Numerical representation of overexpression is indicated by more than two, whereas numerical representation of underexpression is indicated by less than 0.5. Overexpressed singleton indicates that the peptide peak in diseased sample was detected and there was no peak detected in control samples. Underexpressed singleton indicates that the peptide peak was detected in the control sample and there was no peak in the diseased sample.

Table 2 (provided on the CD-R) discloses the PCAT proteins, transcripts, and peptides sequences that correlated to the Table 1.

The transcript/protein information includes:

a protein number (1 through 288)

a Celera protein internal identification number for the protein encoded by the Celera transcript (hCP and/or UID)

a public protein accession number (Genbank e.g., RefSeq NP number, Swiss-prot, or Derwent) for the protein an art-known gene/protein name a Celera transcript internal identification number (hCT and/or UID)

a public transcript accession number (Genbank e.g., RefSeq NM number, or Derwent)

a Celera hCG and UID internal identification numbers for the gene an art-known gene symbol Celera genomic axis position (indicating start nucleotide position-stop nucleotide position)

the chromosome number of the chromosome on which the gene is located an OMIM (Online Mendelian Inheritance in Man; Johns Hopkins University/NCBI) public reference number for obtaining further information regarding the medical significance of each gene alternative gene/protein name(s) and/or symbol(s) in the OMIM entry

DESCRIPTION OF FIGURES

FIG. 2. Kunitz-type 1 protease inhibitor expression in various tumor types by immunohistochemistry.

DETAILED DESCRIPTION OF THE PREFERRED EMBODIMENTS

General Description

Figure 1:
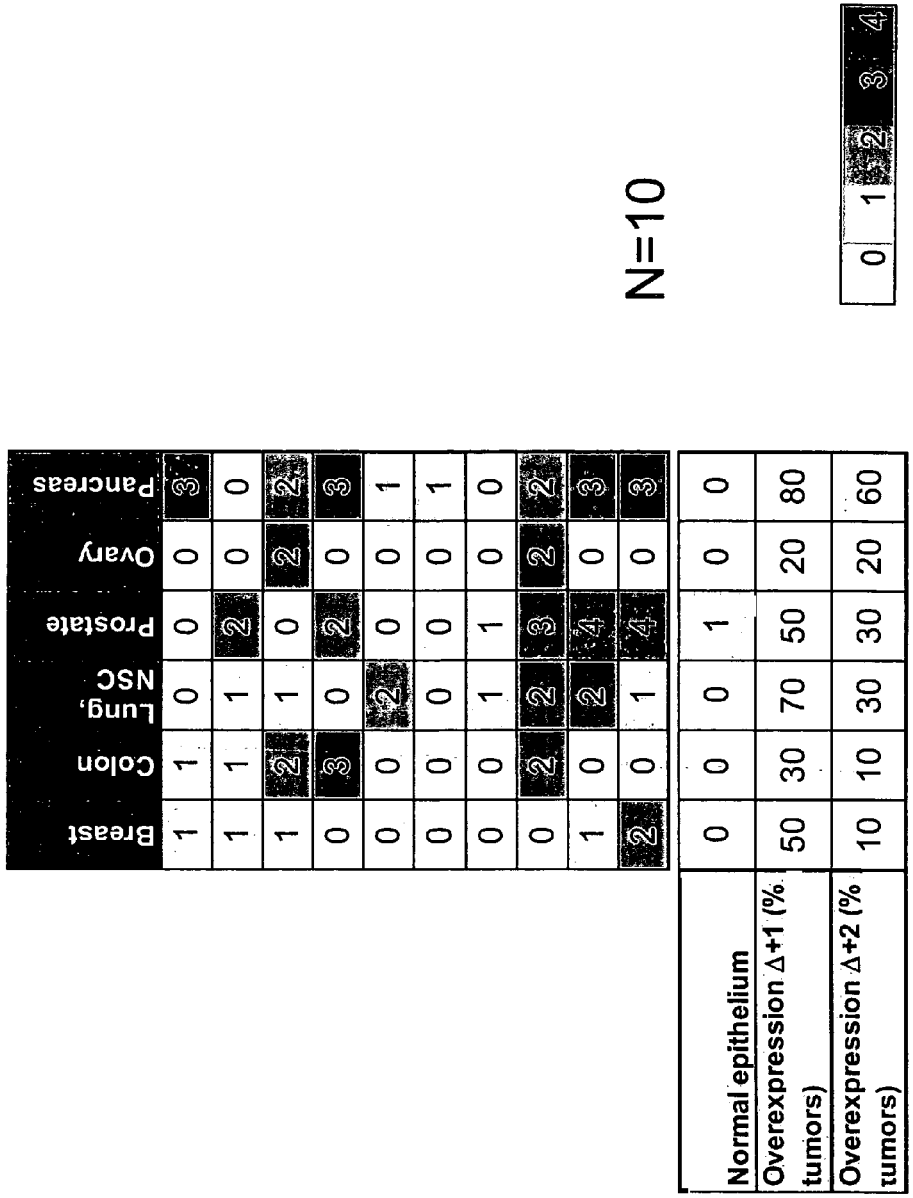
FIG. 1. Tissue Factor expression in various tumor types by immunohistochemistry.

While the broadest definition of this invention is set forth in the Summary of the Invention, certain nucleic acids, peptides or proteins are preferred. For example a preferred method for detecting a pancreatic disease by determining the level of one or more PCAT protein(s) or any fragment(s) thereof is wherein the level of PCAT protein(s) are determined by contacting one or more antibody(ies) that specifically bind to the antigenic regions of the PCAT protein(s). Further preferred is a method wherein the level of two or more proteins are determined, more preferred wherein the level of four or more proteins are determined and most preferred wherein the level of eight or more proteins are determined.

A preferred method for detecting a pancreatic disease by determining the level of one or more PCAT peptide(s) is wherein the level of PCAT peptides(s) are determined by contacting one or more antibody(ies) that specifically bind to the antigenic regions of the PCAT peptide(s). Further preferred is a method wherein the level of five or more peptides are determined, more preferred wherein the level of ten or more peptides are determined and most preferred wherein the level of fifteen or more peptides are determined.

A preferred method for detecting a pancreatic disease by determining the level of one or more PCAT nucleic acid(s) is wherein the level of said PCAT nucleic acid(s) is determined by contacting one or more probes that specifically hybridize to said nucleic acid(s). Further preferred is a method wherein the level of two or more nucleic acids are determined, more preferred wherein the level of four or more nucleic acids are determined and most preferred wherein the level of eight or more nucleic acids are determined.

The methods for detecting a pancreatic disease provided by the present invention may be used for diagnosing the presence of disease in a patent, monitoring the presence of pancreatic disease in patients undergoing treatment and testing for the reoccurrence of pancreatic disease in patients that were successfully treated for the pancreatic disease; preferably wherein the pancreatic disease is pancreatic cancer. The test sample may be, but is not limited to, a biological sample such as tissue, blood, serum or biological fluid.

The present invention is based on the discovery of protein(s) and peptide(s) that are differentially expressed in pancreatic disease samples, for example, cancer sample versus normal pancreatic samples. These proteins and peptide, and the encoding nucleic acid molecules are associated with pancreatic diseases, hereinafter the PCAT proteins, peptides or nucleic acids.

The discovery of disease specific target proteins is base on discoveries made using proteomics techniques. The method uses on MALDI-TOF TOF LC/MS analyses platform to generate protein expression profiles from pancreatic disease tissues or cell lines in an effort to discover and identify novel molecules associated with the disease.

Based on these discoveries, the present invention provides proteins, peptides, nucleic acids that are differential in pancreatic diseases, as well as antibodies binds to the proteins or peptides. The present invention also provides methods for detection, monitoring, diagnosis, prognosis, preventive and treatment of pancreatic diseases. The present invention provides a detection reagent, markers for pancreatic diseases at various stages, comprises PCAT sequences isolated from human pancreatic disease tissue, sera, cell lines, blood or biological fluids.

The present invention provides a method for treating pancreatic diseases targeting at PCAT. The treatment includes administration of a therapeutically effective amount of composition comprise, but not limit to, an antibody, an immunogentic peptide which induces T cell response, a small molecule, a protein or a nucleic acid molecule. The composition further comprises an agonist or antigonist to PCAT. A "Panceratic disease" can include pancreatic cancer, pancreatic tumor (exocrine or endocrine), pancreatic cysts, acute pancreatitis, chronic pancreatitis, diabetes (type I and II) as well as pancreatic trauma, preferably pancreatic cancer.

The present invention may further provide a diagnostic or therapeutic potential for epithelial-cell related cancers, which include but are not limited to pancreas, lung, colon, prostate, ovarian, breast, bladder renal, hepatocellular, pharyngeal and gastric cancers.

The present invention further provides the target for screening an agent for PCAT, wherein the agent is compounds of small molecules, proteins, peptides, nucleic acids, antibodies or other agonists or antigonists.

Specifically, the following targets are selected for targeting purpose: Tissue Factor, GS3786, Na/K ATPase Beta-3, Kunitz Type inhibitor-2 (HAI-2), CD46, CD166, Neutral Amino Acid Transporter (ASCT2), Transglutaminase-2 (TGM2), Kunitz Inhibitor-1, ErbB3, Mucin 4, Decay Accelerating Factor (DAF). These factors are associated with pancreatic cancer and are the potential target for treating pancreatic cancer.

Tissue factor is known for its function for activation of fVII resulting in genenration of tumor growth promoting factors. fVIIa is known to bind TF and may stimulate mitogenic signaling and inhibit apoptosis of tumor cells.

Mucin 4 is a transmembrane mucin composed of two subunits (alpha and beta) generated from proteolytic cleavage (beta is transmembrane, alpha is extracellular). Mucin 4 and erbB2 is localized to the apical membrane and stimulates differentiation of polarized epithelium. Expression of neuregulin[NRG] by stromal elements enables erbB2/erbB3 complex formation which stimulates proliferation. Loss of polarization of epithelial cell allows Mucin 4/erbB2 and erbB3 complex formation, which potentiates proliferative signaling. ErbB3 is unique among the ErbB receptor family in that it possesses little or no intrinsic tyrosine kinase activity. When ErbB3 is co-expressed with ErbB2, an active signaling complex is formed and antidies directded against ErbB2 are capable of disrupting this complex. Monoclonal antibody against ErbB3 has an agonistic effect on the anchorage-independent growth of cell lines expressing this receptor (Rajkumar et al., British J. Cancer, 70(3): 459-465 (1994)).

Kunitz Type Protease Inhibitor-1, also called HAI-1, Serine protease inhibitors or serpins. HAI is associate with hepatocyte growth factor HGF/scatter factor/SF which is thought to play an important role in the regeneration of injured gastrointestinal mucosa by promoting the proliferation and migration of epithelial cells. HGF is activated by HGFA which is activated locally by thrombin. HAI-1 is upregulated and inhibits and sequesters HGFA at the site of injury, thereby ensuring pericellular activation of HGF through upregulation of injury associated proteases. HGFA is released from HAI-1 upon cleavage with cell surface metalloprotease.

Neutral Amino Acid Transporter (ASCT2) is a member of ASC/BO amino acid transporter and it functions as Na+ dependent glutamine transport.

Decay accelerating factor (CD55)'s primary function is to inactivate the C3 convertases of the complement cascade by dissociating them into their constituent proteins. It is expressed on all serum exposed cells and provides protection from complement activated proteases.

PCAT Peptide/Proteins and Peptides

The present invention provides isolated PCAT peptide and protein molecules that consisting of, consisting essentially of, or comprising the amino acid sequences of the PCAT peptides and proteins disclosed in the Tables 1 and 2, (encoded by the nucleic acid molecule shown in Table 2), as well as all obvious variants of these peptides that are within the art to make and use. Some of these variants are described in detail below.

In one embodiment PCAT peptides include, but are not limited to, the amino acid sequence of SEQ ID NOS: 703-873 and variants thereof. A PCAT protein includes, but is not limited to, the amino acid sequence of SEQ ID NOS: 1-288 and variants thereof. PACT proteins may be differentially expressed in pancreatic cell line, blood, tissue, serum or body fluids.

The peptide or protein or fragement thereof, to which the invention pertains, however, are not to be construed as encompassing peptide, protein or fragment that may be disclosed publicly prior to the present invention.

The PCAT proteins and peptides of the present invention can be purified to homogeneity or other degrees of purity. The level of purification will be based on the intended use. The critical feature is that the preparation allows for the desired function of the peptide, even if in the presence of considerable amounts of other components (the features of an isolated nucleic acid molecule is discussed below).

As used herein, a "peptide" is defined as amino acid sequences between 5-20 amino acids derived from PCAT proteins such as SEQ ID NOS: 1-288 or variants thereof. The peptide differentially expressed in either pancreatic diseases cell line, blood, tissue, serum or body fluids. In one embodiment peptides include, but are not limited to, the amino acid sequence of SEQ ID NOS: 703-873, or variants thereof.

As used herein, a "protein" is full-length protein differentially expressed in pancreatic diseases cell line, tissue, blood, serum or body fluids. A protein includes, but is not limited to, the amino acid sequence of SEQ ID NOS: 1-288.

A peptide is said to be "isolated" or "purified" when it is substantially free of cellular material or free of chemical precursors or other chemicals. The peptides of the present invention can be purified to homogeneity or other degrees of purity. The level of purification will be based on the intended use. The critical feature is that the preparation allows for the desired function of the peptide, even if in the presence of considerable amounts of other components (the features of an isolated nucleic acid molecule are discussed below).

In some uses, "substantially free of cellular material" includes preparations of the peptide having less than about 30% (by dry weight) other proteins (i.e., contaminating protein), less than about 20% other proteins, less than about 10% other proteins, or less than about 5% other proteins. When the peptide is recombinantly produced, it can also be substantially free of culture medium, i.e., culture medium represents less than about 20% of the volume of the protein preparation.

The language "substantially free of chemical precursors or other chemicals" includes preparations of the peptide in which it is separated from chemical precursors or other chemicals that are involved in its synthesis. In one embodiment, the language "substantially free of chemical precursors or other chemicals" includes preparations of the PCAT peptide having less than about 30% (by dry weight) chemical precursors or other chemicals, less than about 20% chemical precursors or other chemicals, less than about 10% chemical precursors or other chemicals, or less than about 50% chemical precursors or other chemicals.

The isolated PCAT proteins and peptide can be purified from cells that naturally express it, purified from cells that have been altered to express it (recombinant), or synthesized using known protein synthesis methods. Sambrook et al., Molecular Cloning: A Laboratory Manual. 3rd. ed., Cold Spring Harbor Laboratory Press, Cold Spring Harbor, N.Y., (2001). Experimental data as provided in Table 1 indicates expression in humans pancreatic cell lines. For example, a nucleic acid molecule encoding the PCAT protein or peptide is cloned into an expression vector, the expression vector introduced into a host cell and the protein expressed in the host cell. The protein or peptide can then be isolated from the cells by an appropriate purification scheme using standard protein purification techniques. Many of these techniques are described in detail below.

A PCAT peptide or protein can be attached to heterologous sequences to form chimeric or fusion proteins. Such Schimeric and fusion proteins comprise a peptide operatively linked to a heterologous protein having an amino acid sequence not substantially homologous to the peptide. "Operatively linked" indicates that the peptide and the heterologous protein are fused in-frame. The heterologbus protein can be fused to the N-terminus or C-terminus of the peptide.

In some uses, the fusion protein does not affect the activity of the peptide or protein per se. For example, the fusion protein can include, but is not limited to, fusion proteins, for example beta-galactosidase fusions, yeast two-hybrid GAL fusions, poly-His fusions, MYC-tagged, HI-tagged and Ig fusions. Such fusion proteins, particularly poly-His fusions, can facilitate the purification of recombinant PCAT proteins or peptides. In certain host cells (e.g., mammalian host cells), expression and/or secretion of a protein can be increased by using a heterologous signal sequence.

A chimeric or fusion PCAT protein or peptide can be produced by standard recombinant DNA techniques. For example, DNA fragments coding for the different protein sequences are ligated together in-frame in accordance with conventional techniques. In another embodiment, the fusion gene can be synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence (see Ausubel et al., Current Protocols in Molecular Biology, 1992). Moreover, many expression vectors are commercially available that already encode a fusion moiety (e.g., a GST protein). A PCAT-encoding nucleic acid can be cloned into such an expression vector such that the fusion moiety is linked in-frame to the PCAT protein or peptide.

As mentioned above, the PCAT peptide or the PCAT protein has obvious variants of the amino acid sequence, such as naturally occurring mature forms of the PCAT, allelic/sequence variants of the PCAT, non-naturally occurring recombinantly derived variants of the PCAT, and orthologs and paralogs of the PCAT proteins or peptides. Such variants can readily be generated using art-known techniques in the fields of recombinant nucleic acid technology and protein biochemistry.

It is understood, however, that PCAT and variants exclude any amino acid sequences disclosed prior to the invention.

Such variants can readily be identified/made using molecular techniques and the sequence information disclosed herein. Further, such variants can readily be distinguished from other peptides based on sequence and/or structural homology to the PCAT peptides of the present invention. The degree of homology/identity present will be based primarily on whether the peptide is a functional variant or non-functional variant, the amount of divergence present in the paralog family and the evolutionary distance between the orthologs.

To determine the percent identity of two amino acid sequences or two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity and similarity between two sequences can be accomplished using a mathematical algorithm. (Computational Molecular Biology, Lesk, A. M., ed., Oxford University Press, New York, 1988; Biocomputing: Informatics and Genome Projects, Smith, D. W., ed., Academic Press, New York, 1993; Computer Analysis of Sequence Data, Part 1, Griffin, A. M., and Griffin, H. G., eds., Humana Press, New Jersey, 1994; Sequence Analysis in Molecular Biology, von Heinje, G., Academic Press, 1987; and Sequence Analysis Primer, Gribskov, M. and Devereux, J., eds., M Stockton Press, New York, 1991). In a preferred embodiment, the percent identity between two amino acid sequences is determined using the Needleman and Wunsch (J. Mol. Biol. (48): 444-453 (1970)) algorithm which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package (Devereux, J., et al., Nucleic Acids Res. 12(1): 387 (1984)), using a NWSgapdna.CMP matrix and a gap weight of 40, 50, 60, 70, or 80 and a length weight of 1, 2, 3, 4, 5, or 6. In another embodiment, the percent identity between two amino acid or nucleotide sequences is determined using the algorithm of E. Myers and W. Miller (CABIOS, 4: 11-17 (1989)) which has been incorporated into the ALIGN program (version 2.0), using a PAM120 weight residue table, a gap length penalty of 12 and a gap penalty of 4.

The nucleic acid and protein sequences of the present invention can further be used as a "query sequence" to perform a search against sequence databases to, for example, identify other family members or related sequences. Such searches can be performed using the NBLAST and XBLAST programs (version 2.0) of Altschul, et al. (J. Mol. Biol. 215: 403-10 (1990)). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized as described in Altschul et al. (Nucleic Acids Res. 25(17): 3389-3402 (1997)). When utilizing BLAST and gapped BLAST programs, the default parameters of the respective programs (e.g., XBLAST and NBLAST) can be used.

Full-length pre-processed forms, as well as mature processed forms, of proteins that comprise one of the peptides of the present invention can readily be identified as having complete sequence identity to one of the PCAT peptides of the present invention as well as being encoded by the same genetic locus as the PCAT peptide provided herein (See Table 2).

Allelic variants of a PCAT peptide can readily be identified as being a human protein having a high degree (significant) of sequence homology/identity to at least a portion of the PCAT peptide as well as being encoded by the same genetic locus as the PCAT peptide provided herein. Genetic locus can readily be determined based on the genomic information provided in Table 2, such as the genomic sequence mapped to the reference human. As used herein, two proteins (or a region of the proteins) have significant homology when the amino acid sequences are typically at least about 70-80%, 80-90%, and more typically at least about 90-95% or more homologous. A significantly homologous amino acid sequence, according to the present invention, will be encoded by a nucleic acid sequence that will hybridize to a PCAT peptide encoding nucleic acid molecule under stringent conditions as more fully described below.

Paralogs of a PCAT peptide can readily be identified as having some degree of significant sequence homology/identity to at least a portion of the PCAT peptide, as being encoded by a gene from humans, and as having similar activity or function. Two proteins will typically be considered paralogs when the amino acid sequences are typically at least about 60% or greater, and more typically at least about 70% or greater homology through a given region or domain. Such paralogs will be encoded by a nucleic acid sequence that will hybridize to a PCAT peptide encoding nucleic acid molecule under moderate to stringent conditions as more fully described below.

Orthologs of a PCAT peptide can readily be identified as having some degree of significant sequence homology/identity to at least a portion of the PCAT peptide as well as being encoded by a gene from another organism. Preferred orthologs will be isolated from mammals, preferably primates, for the development of human therapeutic targets and agents. Such orthologs will be encoded by a nucleic acid sequence that will hybridize to a PCAT peptide encoding nucleic acid molecule under moderate to stringent conditions, as more fully described below, depending on the degree of relatedness of the two organisms yielding the proteins.

Non-naturally occurring variants of the PCAT peptides of the present invention can readily be generated using recombinant techniques. Such variants include, but are not limited to deletions, additions and substitutions in the amino acid sequence of the PCAT peptide. For example, one class of substitutions is conserved amino acid substitution. Such substitutions are those that substitute a given amino acid in a PCAT peptide by another amino acid of like characteristics. Typically seen as conservative substitutions are the replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found in Bowie et al., Science 247: 1306-1310 (1990).

Variant PCAT peptides can be fully functional or can lack function in one or more activities, e.g. ability to bind substrate, ability to phosphorylate substrate, ability to mediate signaling, etc. Fully functional variants typically contain only conservative variation or variation in non-critical residues or in non-critical regions.

Non-functional variants typically contain one or more non-conservative amino acid substitutions, deletions, insertions, inversions, or truncation or a substitution, insertion, inversion, or deletion in a critical residue or critical region.

Amino acids that are essential for function can be identified by methods known in the art, such as site-directed mutagenesis or alanine-scanning mutagenesis (Cunningham et al., Science 244: 1081-1085 (1989)). The latter procedure introduces single alanine mutations at every residue in the molecule. The resulting mutant molecules are then tested for biological activity such as PCAT activity or in assays such as an in vitro proliferative activity. Sites that are critical for binding partner/substrate binding can also be determined by structural analysis such as crystallization, nuclear magnetic resonance or photoaffinity labeling (Smith et al., J. Mol. Biol. 224: 899-904 (1992); de Vos et al. Science 255: 306-312 (1992)).

The present invention further provides fragments of the PCATs, in addition to proteins and peptides that comprise and consist of such fragments, particularly those comprising the residues identified in Tables 1 and 2. As used herein, a fragment comprises at least 8, 10, 12, 14, 16, 18, 20 or more contiguous amino acid residues from a PCAT. Such fragments can be chosen based on the ability to retain one or more of the biological activities of the PCAT or could be chosen for the ability to perform a function, e.g. bind a substrate or act as an immunogen. Particularly important fragments are biologically active fragments, peptides that are, for example, about 8 or more amino acids in length. Such fragments will typically comprise a domain or motif of the PCAT, e.g., active site, a transmembrane domain or a substrate-binding domain. Further, possible fragments include, but are not limited to, domain or motif containing fragments, soluble peptide fragments, and fragments containing immunogenic structures. Predicted domains and functional sites are readily identifiable by computer programs well known and readily available to those of skill in the art (e.g., PROSITE analysis).

Polypeptides often contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Common modifications that occur naturally in PCATs are described in basic texts, detailed monographs, and the research literature, and they are well known to those of skill in the art.

Known modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such modifications are well known to those of skill in the art and have been described in great detail in the scientific literature. Several particularly common modifications, glycosylation, lipid attachment, sulfation, gamma-carboxylation of glutamic acid residues, hydroxylation and ADP-ribosylation, for instance, are described in most basic texts, such as Proteins—Structure and Molecular Properties, 2nd Ed., T. E. Creighton, W. H. Freeman and Company, New York (1993). Many detailed reviews are available on this subject, such as by Wold, F., Posttranslational Covalent Modification of Proteins, B. C. Johnson, Ed., Academic Press, New York 1-12 (1983); Seifter et al. (Meth. Enzymol. 182: 626-646 (1990)) and Rattan et al. (Ann. N.Y. Acad. Sci. 663: 48-62 (1992)).

Accordingly, the PCATs of the present invention also encompass derivatives or analogs in which a substituted amino acid residue is not one encoded by the genetic code, in which a substituent group is included, in which the mature PCAT is fused with another compound, such as a compound to increase the half-life of the PCAT (for example, polyethylene glycol), or in which the additional amino acids are fused to the mature PCAT, such as a leader or secretory sequence or a sequence for purification of the mature PCAT or a pro-protein sequence.

Protein/Peptide Uses

The proteins of the present invention can be used in substantial and specific assays related to the functional information provided in the Tables; to raise antibodies or to elicit another immune response; as a reagent (including the labeled reagent) in assays designed to quantitatively determine levels of the protein (or its binding partner or ligand) in biological fluids; and as markers for tissues in which the corresponding protein is preferentially expressed (either constitutively or at a particular stage of tissue differentiation or development or in a disease state). Where the protein binds or potentially binds to another protein or ligand (such as, for example, in a PCAT-effector protein interaction or PCAT-ligand interaction), the protein can be used to identify the binding partner/ligand so as to develop a system to identify inhibitors of the binding interaction. Any or all of these uses are capable of being developed into reagent grade or kit format for commercialization as commercial products.

Methods for performing the uses listed above are well known to those skilled in the art. References disclosing such methods include "Molecular Cloning: A Laboratory Manual", 3rd ed., Cold Spring Harbor Laboratory Press, Sambrook, J., E. F. Fritsch and T. Maniatis eds., 2001, and "Methods in Enzymology: Guide to Molecular Cloning Techniques", Academic Press, Berger, S. L. and A. R. Kimmel eds., 1987.

The potential uses of the peptides of the present invention are based primarily on the source of the protein as well as the class/action of the protein. For example, PCATs isolated from humans and their human/mammalian orthologs serve as, targets for identifying agents for use in mammalian therapeutic applications, e.g. a human drug, particularly in modulating a biological or pathological response in a cell or tissue that expresses the PCAT. Experimental data as provided in Table 1 indicate that the PCATs of the present invention are expressed at differential level in various pancreatic cell lines, for example SEQ ID NOS: 1-119 are overexpressed in all tested cell lines, whereas other proteins or peptides are underexpressed in selected cell lines. In one example, protein (SEQ ID NO: 120) or peptide (SEQ ID NO: 761) is overexpressed in one cell line (HPAC), yet underexpressed in another cell line (Su.86.86). A large percentage of pharmaceutical agents are being developed that modulate the activity of PCAT proteins, particularly members of the PCAT subfamily (see Background of the Invention). The structural and functional information provided in the Background and Figures provide specific and substantial uses for the molecules of the present invention, particularly in combination with the expression information provided in Table 1. Experimental data as provided in Table 1 indicates expression in humans pancreatic cell lines. Such uses can readily be determined using the information provided herein, that which is known in the art, and routine experimentation.

The proteins of the present invention (including variants and fragments that may have been disclosed prior to the present invention) are useful for biological assays related to PCATs that are related to members of the PCAT subfamily. Such assays involve any of the known PCAT functions or activities or properties useful for diagnosis and treatment of PCAT-related conditions that are specific for the subfamily of PCATs that the one of the present invention belongs to, particularly in cells and tissues that express the PCAT. Experimental data as provided in Table 1 indicate that the PCATs of the present invention are expressed at differential level in various pancreatic cell lines, for example SEQ ID NOS: 1-119 are overexpressed in all tested cell lines, whereas other proteins or peptides are underexpressed in selected cell lines. In one example, protein (SEQ ID NO: 120) or peptide (SEQ ID NO: 761) is overexpressed in one cell line (HPAC), yet underexpressed in another cell line (Su.86.86).

The proteins of the present invention are also useful in drug screening assays, in cell-based or cell-free systems. Cell-based systems can be native, i.e., cells that normally express the PCAT, as a biopsy or expanded in cell culture. Experimental data as provided in Table 1 indicates expression in human pancreatic cell lines. In an alternate embodiment, cell-based assays involve recombinant host cells expressing the PCAT protein.

The polypeptides can be used to identify compounds or agents that modulate PCAT activity of the protein in its natural state or an altered form that causes a specific disease or pathology associated with the PCAT. Both the PCATs of the present invention and appropriate variants and fragments can be used in high-throughput screens to assay candidate compounds for the ability to bind to the PCAT. These compounds can be further screened against a functional PCAT to determine the effect of the compound on the PCAT activity. Further, these compounds can be tested in animal or invertebrate systems to determine activity/effectiveness. Compounds can be identified that activate (agonist) or inactivate (antagonist) the PCAT to a desired degree.

Further, the proteins of the present invention can be used to screen a compound or an agent for the ability to stimulate or inhibit interaction between the PCAT protein and a molecule that normally interacts with the PCAT protein, e.g. a substrate or or an extracellular binding ligand or a component of the signal pathway that the PCAT protein normally interacts (for example, a cytosolic signal proein or another PCAT). Such assays typically include the steps of combining the PCAT protein with a candidate compound under conditions that allow the PCAT protein, or fragment, to interact with the target molecule, and to detect the formation of a complex between the protein and the target or to detect the biochemical consequence of the interaction with the PCAT protein and the target, such as any of the associated effects of signal transduction such as protein phosphorylation, cAMP turnover, and adenylate cyclase activation, etc.

Candidate compounds or agents include, for example, 1) peptides such as soluble peptides, including Ig-tailed fusion peptides and members of random peptide libraries (see, e.g., Lam et al., Nature 354: 82-84 (1991); Houghten et al., Nature 354: 84-86 (1991)) and combinatorial chemistry-derived molecular libraries made of D- and/or L-configuration amino acids; 2) phosphopeptides (e.g., members of random and partially degenerate, directed phosphopeptide libraries, see, e.g. Songyang et al., Cell 72: 767-778 (1993)); 3) antibodies (e.g., polyclonal, monoclonal, humanized, anti-idiotypic, chimeric, and single chain antibodies as well as Fab, F(ab')2, Fab expression library fragments, and epitope-binding fragments of antibodies); and 4) small organic and inorganic molecules (e.g., molecules obtained from combinatorial and natural product libraries).

One candidate compound or agent is a soluble fragment of the PCAT that competes for substrate binding. Other candidate compounds include mutant PCATs or appropriate fragments containing mutations that affect PCAT function and thus compete for substrate. Accordingly, a fragment that competes for substrate, for example with a higher affinity, or a fragment that binds substrate but does not allow release, is encompassed by the invention.

The invention further includes other end point assays to identify compounds that modulate (stimulate or inhibit) PCAT activity. The assays typically involve an assay of events in the signal transduction pathway that indicate PCAT activity. Thus, the phosphorylation of a substrate, activation of a protein, a change in the expression of genes that are up- or down-regulated in response to the PCAT protein dependent signal cascade can be assayed.

Any of the biological or biochemical functions mediated by the PCAT can be used as an endpoint assay. These include all of the biochemical or biochemical/biological events described herein, in the references cited herein, incorporated by reference for these endpoint assay targets, and other functions known to those of ordinary skill in the art or that can be readily identified using the information provided in the Tables, particularly Table 1. Specifically, a biological function of a cell or tissues that expresses the PCAT can be assayed. Experimental data as provided in Table 1 indicate that the PCATs of the present invention are expressed at differential level in various pancreatic cell lines, for example SEQ ID NOS: 1-119 are overexpressed in all tested cell lines, whereas other proteins or peptides are underexpressed in selected cell lines. In one example, protein (SEQ ID NO: 120) or peptide (SEQ ID NO: 761) is overexpressed in one cell line (HPAC), yet underexpressed in another cell line (Su.86.86).

Binding and/or activating compounds can also be screened by using chimeric PCAT proteins in which the amino terminal extracellular domain, or parts thereof, the entire transmembrane domain or subregions, such as any of the seven transmembrane segments or any of the intracellular or extracellular loops and the carboxy terminal intracellular domain, or parts thereof, can be replaced by heterologous domains or subregions. For example, a substrate-binding region can be used that interacts with a different substrate then that which is recognized by the native PCAT. Accordingly, a different set of signal transduction components is available as an end-point assay for activation. This allows for assays to be performed in other than the specific host cell from which the PCAT is derived.

The proteins of the present invention are also useful in competition binding assays in methods designed to discover compounds that interact with the PCAT (e.g. binding partners and/or ligands). Thus, a compound is exposed to a PCAT polypeptide under conditions that allow the compound to bind or to otherwise interact with the polypeptide. Soluble PCAT polypeptide is also added to the mixture. If the test compound interacts with the soluble PCAT polypeptide, it decreases the amount of complex formed or activity from the PCAT. This type of assay is particularly useful in cases in which compounds are sought that interact with specific regions of the PCAT. Thus, the soluble polypeptide that competes with the target PCAT region is designed to contain peptide sequences corresponding to the region of interest.

To perform cell free drug screening assays, it is sometimes desirable to immobilize either the PCAT protein, or fragment, or its target molecule to facilitate separation of complexes from uncomplexed forms of one or both of the proteins, as well as to accommodate automation of the assay.

Techniques for immobilizing proteins on matrices can be used in the drug screening assays. In one embodiment, a fusion protein can be provided which adds a domain that allows the protein to be bound to a matrix. For example, glutathione-S-transferase fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and the candidate compound, and the mixture incubated under conditions conducive to complex formation (e.g., at physiological conditions for salt and pH). Following incubation, the beads are washed to remove any unbound label, and the matrix immobilized and radiolabel determined directly, or in the supernatant after the complexes are dissociated. Alternatively, the complexes can be dissociated from the matrix, separated by SDS-PAGE, and the level of PCAT-binding protein found in the bead fraction quantitated from the gel using standard electrophoretic techniques. For example, either the polypeptide or its target molecule can be immobilized utilizing conjugation of biotin and streptavidin using techniques well known in the art. Alternatively, antibodies reactive with the protein but which do not interfere with binding of the protein to its target molecule can be derivatized to the wells of the plate, and the protein trapped in the wells by antibody conjugation. Preparations of a PCAT-binding protein and a candidate compound are incubated in the PCAT protein-presenting wells and the amount of complex trapped in the well can be quantitated. Methods for detecting such complexes, in addition to those described above for the GST-immobilized complexes, include immunodetection of complexes using antibodies reactive with the PCAT protein target molecule, or which are reactive with PCAT protein and compete with the target molecule, as well as PCAT-linked assays which rely on detecting an enzymatic activity associated with the target molecule.

Agents that modulate one of the PCATs of the present invention can be identified using one or more of the above assays, alone or in combination. It is generally preferable to use a cell-based or cell free system first and then confirm activity in an animal or other model system. Such model systems are well known in the art and can readily be employed in this context.

Modulators of PCAT protein activity identified according to these drug screening assays can be used to treat a subject with a disorder mediated by the PCAT pathway, by treating cells or tissues that express the PCAT. Experimental data as provided in Table 1 indicates expression in human pancreatic cell lines. These methods of treatment include the steps of administering a modulator of PCAT activity in a pharmaceutical composition to a subject in need of such treatment, the modulator being identified as described herein.

In yet another aspect of the invention, the PCAT proteins can be used as "bait proteins" in a two-hybrid assay or three-hybrid assay (see, e.g., U.S. Pat. No. 5,283,317; Zervos et al. (1993) Cell 72: 223-232; Madura et al. (1993) J. Biol. Chem. 268: 12046-12054; Bartel et al. (1993) Biotechniques 14: 920-924; Iwabuchi et al. (p993) Oncogene 8: 1693-1696; and Brent WO94/10300), to identify other proteins, which bind to or interact with the PCAT and are involved in PCAT activity. Such PCAT-binding proteins are also likely to be involved in the propagation of signals by the PCAT proteins or PCAT targets as, for example, downstream elements of a PCAT-mediated signaling pathway. Alternatively, such PCAT-binding proteins are likely to be PCAT inhibitors.

The two-hybrid system is based on the modular nature of most transcription factors, which consist of separable DNA-binding and activation domains. Briefly, the assay utilizes two different DNA constructs. In one construct, the gene that codes for a PCAT protein is fused to a gene encoding the DNA binding domain of a known transcription factor (e.g., GAL-4). In the other construct, a DNA sequence, from a library of DNA sequences that encode an unidentified protein ("prey" or "sample") is fused to a gene that codes for the activation domain of the known transcription factor. If the "bait" and the "prey" proteins are able to interact, in vivo, forming a PCAT-dependent complex, the DNA-binding and activation domains of the transcription factor are brought into close proximity. This proximity allows transcription of a reporter gene (e.g., LacZ) which is operably linked to a transcriptional regulatory site responsive to the transcription factor. Expression of the reporter gene can be detected and cell colonies containing the functional transcription factor can be isolated and used to obtain the cloned gene which encodes the protein which interacts with the PCAT protein.

This invention further pertains to novel agents identified by the above-described screening assays. Accordingly, it is within the scope of this invention to further use an agent identified as described herein in an appropriate animal model. For example, an agent identified as described herein (e.g., a PCAT-modulating agent, an antisense PCAT nucleic acid molecule, an PCAT-RNAi fragment, a PCAT-specific antibody, or a PCAT-binding partner) can be used in an animal or other model to determine the efficacy, toxicity, or side effects of treatment with such an agent. Alternatively, an agent identified as described herein can be used in an animal or other model to determine the mechanism of action of such an agent.

Furthermore, this invention pertains to uses of novel agents identified by the above-described screening assays for treatments as described herein.

The PCAT proteins of the present invention are also useful to provide a target for diagnosing a disease or predisposition to disease mediated by the peptide. Accordingly, the invention provides methods for detecting the presence, or levels of, the protein (or encoding mRNA) in a cell, tissue, or organism. Experimental data as provided in Table 1 indicates expression in human pancreatic cell lines. The method involves contacting a biological sample with a compound capable of interacting with the PCAT protein such that the interaction can be detected. Such an assay can be provided in a single detection format or a multi-detection format such as an antibody chip array.

One agent for detecting a protein in a sample is an antibody capable of selectively binding to protein. A biological sample includes tissues, cells and biological fluids isolated from a subject, as well as tissues, cells and fluids present within a subject.

The peptides of the present invention also provide targets for diagnosing active protein activity, disease, or predisposition to disease, in a patient having a variant peptide, particularly activities and conditions that are known for other members of the family of proteins to which the present one belongs. Thus, the peptide can be isolated from a biological sample and assayed for the presence of a genetic mutation that results in aberrant peptide. This includes amino acid substitution, deletion, insertion, rearrangement, (as the result of aberrant splicing events), and inappropriate post-translational modification. Analytic methods include altered electrophoretic mobility, altered tryptic peptide digest, altered PCAT activity in cell-based or cell-free assay, alteration in substrate or antibody-binding pattern, altered isoelectric point, direct amino acid sequencing, and any other of the known assay techniques useful for detecting mutations in a protein. Such an assay can be provided in a single detection format or a multi-detection format such as an antibody chip array.

In vitro techniques for detection of peptide include enzyme linked immunosorbent assays (ELISAs), Western blots, immunoprecipitations and immunofluorescence using a detection reagent, such as an antibody or protein binding agent. Alternatively, the peptide can be detected in vivo in a subject by introducing into the subject a labeled anti-peptide antibody or other types of detection agent. For example, the antibody can be labeled with a radioactive marker whose presence and location in a subject can be detected by standard imaging techniques. Particularly useful are methods that detect the allelic variant of a peptide expressed in a subject and methods which detect fragments of a peptide in a sample.

The peptides are also useful in pharmacogenomic analysis. Pharmacogenomics deal with clinically significant hereditary variations in the response to drugs due to altered drug disposition and abnormal action in affected persons. See, e.g., Eichelbaum, M. (Clin. Exp. Pharmacol. Physiol. 23(10-11): 983-985 (1996)), and Linder, M. W. (Clin. Chem. 43(2): 254-266 (1997)). The clinical outcomes of these variations result in severe toxicity of therapeutic drugs in certain individuals or therapeutic failure of drugs in certain individuals as a result of individual variation in metabolism. Thus, the genotype of the individual can determine the way a therapeutic compound acts on the body or the way the body metabolizes the compound. Further, the activity of drug metabolizing enzymes affects both the intensity and duration of drug action. Thus, the pharmacogenomics of the individual permit the selection of effective compounds and effective dosages of such compounds for prophylactic or therapeutic treatment based on the individual's genotype. The discovery of genetic polymorphisms in some drug metabolizing enzymes has explained why some patients do not obtain the expected drug effects, show an exaggerated drug effect, or experience serious toxicity from standard drug dosages. Polymorphisms can be expressed in the phenotype of the extensive metabolizer and the phenotype of the poor metabolizer. Accordingly, genetic polymorphism may lead to allelic protein variants of the PCAT protein in which one or more of the PCAT functions in one population are different from those in another population. The peptides thus allow a target to ascertain a genetic predisposition that can affect treatment modality. Thus, in a ligand-based treatment, polymorphism may give rise to amino terminal extracellular domains and/or other substrate-binding regions that are more or less active in substrate binding, and PCAT activation. Accordingly, substrate dosage would necessarily be modified to maximize the therapeutic effect within a given population containing a polymorphism. As an alternative to genotyping, specific polymorphic peptides could be identified.

The peptides are also useful for treating a disorder characterized by an absence of, inappropriate, or unwanted expression of the protein. Experimental data as provided in Table 1 indicates expression in human pancreatic cell-lines. Accordingly, methods for treatment include the use of the PCAT protein or fragments.

Antibodies

The present invention provides antibodies specifically bind to PCAT proteins or fragments thereof, peptides, or antigenic portion thereof.

The invention also provides antibodies that selectively bind to one of the peptides of the present invention, a protein comprising such a peptide, as well as variants and fragments thereof as describe above.

The antibody of present invention selectively binds a target PCAT when it binds the target domain and does not significantly bind to unrelated proteins. An antibody is still considered to selectively bind a peptide even if it also binds to other proteins that are not substantially homologous with the target peptide so long as such proteins share homology with a fragment or domain of the peptide target of the antibody. In this case, it would be understood that antibody binding to the peptide is still selective despite some degree of cross-reactivity.

The term "antibody" is used in the broadest sense, and specifically covers monoclonal antibodies (including full length monoclonal antibodies), polyclonal antibodies, multi-specific antibodies (e.g., bispecific antibodies), humanized antibody and antibody fragments (e.g., Fab, F(ab').sub.2 and Fv) so long as they exhibit the desired biological activity. Antibodies (Abs) and immunoglobulins (Igs) are glycoproteins having the same structural characteristics. While antibodies exhibit binding specificity to a specific antigen, immunoglobulins include both antibodies and other antibody-like molecules that lack antigen specificity.

As used herein, antibodies are usually heterotetrameric glycoproteins of about 150,000 daltons, composed of two identical light (L) chains and two identical heavy (H) chains. Each light chain is linked to a heavy chain by one covalent disulfide bond, while the number of disulfide linkages varies between the heavy chains of different immunoglobulin isotypes. Each heavy and light chain also has regularly spaced intrachain disulfide bridges. Each heavy chain has at one end a variable domain (VH) followed by a number of constant domains. Each light chain has a variable domain at one end (VL) and a constant domain at its other end. The constant domain of the light chain is aligned with the first constant domain of the heavy chain, and the light chain variable domain is aligned with the variable domain of the heavy chain. Particular amino acid residues are believed to form an interface between the light and heavy chain variable domains. Chothia et al., J. Mol. Biol. 186, 651-63 (1985); Novotny and Haber, Proc. Natl. Acad. Sci. USA 82 4592-4596 (1985).

An "isolated" antibody is one which has been identified and separated and/or recovered from a component of the environment in which is produced. Contaminant components of its production environment are materials that would interfere with diagnostic or therapeutic uses for the antibody, and may include enzymes, hormones, and other proteinaceous or nonproteinaceous solutes. In preferred embodiments, the antibody will be purified as measurable by at least three different methods: 1) to greater than 95% by weight of antibody as determined by the Lowry method, and most preferably more than 99% by weight; 2) to a degree sufficient to obtain at least 15 residues of N-terminal or internal amino acid sequence by use of a spinning cup sequentator; or 3) to homogeneity by SDS-PAGE under reducing or non-reducing conditions using Coomasie blue or, preferably, silver stain. Isolated antibody includes the antibody in situ within recombinant cells since at least one component of the antibody's natural environment will not be present. Ordinarily, however, isolated antibody will be prepared by at least one purification step.

An "antigenic region" or "antigenic determinant" or an "epitope" includes any protein determinant capable of specific binding to an antibody. This is the site on an antigen to which each distinct antibody molecule binds. Epitopic determinants usually consist of active surface groupings of molecules such as amino acids or sugar side chains and usually have specific three-dimensional structural characteristics, as well as charge characteristics.

"Antibody specificity," is an antibody, which has a stronger binding affinity for an antigen from a first subject species than it has for a homologue of that antigen from a second subject species. Normally, the antibody "bind specifically" to a human antigen (i.e., has a binding affinity (Kd) value of no more than about $1 \times 10^{-7}$ M, preferably no more than about $1 \times 10^{-8}$ M and most preferably no more than about $1 \times 10^{-9}$ M) but has a binding affinity for a homologue of the antigen from a second subject species which is at least about 50 fold, or at least about 500 fold, or at least about 1000 fold, weaker than its binding affinity for the human antigen. The antibody can be of any of the various types of antibodies as defined above, but preferably is a humanized or human antibody (Queen et al., U.S. Pat. Nos. 5,530,101, 5,585,089; 5,693,762; and 6,180,370).

The present invention provides an "antibody variant," which refers to an amino acid sequence variant of an antibody wherein one or more of the amino acid residues have been modified. Such variant necessarily have less than 100% sequence identity or similarity with the amino acid sequence having at least 75%, amino acid sequence identity or similarity with the amino acid sequence of either the heavy or light chain variable domain of the antibody, more preferably at least 80%, more preferably at least 85%, more preferably at least 90%, and most preferably at least 95%. Since the method of the invention applies equally to both polypeptides, antibodies and fragments thereof, these terms are sometimes employed interchangeably.

The term "variable" in the context of variable domain of antibodies refers to the fact that certain portions of the variable domains differ extensively in sequence among antibodies and are used in the binding and specificity of each particular antibody for its particular antigen. However, the variability is not evenly distributed through the variable domains of antibodies. It is concentrated in three segments called complementarity determining regions (CDRs) also known as hypervariable regions both in the light chain and the heavy chain variable domains. There are at least two techniques for determining CDRs: (1) an approach based on cross-species sequence variability (i.e., Kabat et al., Sequences of Proteins of Immunological Interest (National Institute of Health, Bethesda, Md. 1987); and (2) an approach based on crystallographic studies of antigen-antibody complexes (Chothia, C. et al. (1989), Nature 342: 877). The more highly conserved portions of variable domains are called the framework (FR). The variable domains of native heavy and light chains each comprise four FR regions, largely adopting a β-Sheet configuration, connected by three CDRs, which form loops connecting, and in some cases forming part of, the β-sheet structure. The CDRs in each chain are held together in close proximity by the FR regions and, with the CDRs from the other chain, contribute to the formation of the antigen-binding site of antibodies (see Kabat et al.) The constant domains are not involved directly in binding an antibody to an antigen, but exhibit various effector functions, such as participation of the antibody in antibody-dependent cellular toxicity.

The term "antibody fragment" refers to a portion of a full-length antibody, generally the antigen binding or variable region. Examples of antibody fragments include Fab, Fab', F(ab')$_2$ and Fv fragments. Papain digestion of antibodies produces two identical antigen binding fragments, called the Fab fragment, each with a single antigen binding site, and a residual "Fc" fragment, so-called for its ability to crystallize readily. Pepsin treatment yields an F(ab')$_2$ fragment that has two antigen binding fragments which are capable of crosslinking antigen, and a residual other fragment (which is termed pFc'). Additional fragments can include diabodies, linear antibodies, single-chain antibody molecules, and multispecific antibodies formed from antibody fragments. As used herein, "functional fragment" with respect to antibodies, refers to Fv, F(ab) and F(ab')$_2$ fragments.

An "Fv" fragment is the minimum antibody fragment that contains a complete antigen recognition and binding site. This region consists of a dimer of one heavy and one light chain variable domain in a tight, non-covalent association ($V_H$-$V_L$ dimer). It is in this configuration that the three CDRs of each variable domain interact to define an antigen-binding site on the surface of the $V_H$-$V_L$ dimer. Collectively, the six CDRs confer antigen-binding specificity to the antibody. However, even a single variable domain (or half of an Fv comprising only three CDRs specific for an antigen) has the ability to recognize and bind antigen, although at a lower affinity than the entire binding site.

The Fab fragment [also designated as F(ab)] also contains the constant domain of the light chain and the first constant domain (CH1) of the heavy chain. Fab' fragments differ from Fab fragments by the addition of a few residues at the carboxyl terminus of the heavy chain CH1 domain including one or more cysteines from the antibody hinge region. Fab'-SH is the designation herein for Fab' in which the cysteine residue(s) of the constant domains have a free thiol group. F(ab') fragments are produced by cleavage of the disulfide bond at the hinge cysteines of the F(ab')$_2$ pepsin digestion product. Additional chemical couplings of antibody fragments are known to those of ordinary skill in the art.

The present invention further provides monoclonal antibodies, polyclonal antibodies as well as humanized antibody.

In general, to generate antibodies, an isolated peptide is used as an immunogen and is administered to a mammalian organism, such as a rat, rabbit or mouse. The full-length protein, an antigenic peptide fragment or a fusion protein of the PCAT protein can be used. Particularly important fragments are those covering functional domains, some but not all the examples of the domains are identified in Tables. Many methods are known for generating and/or identifying antibodies to a given target peptide. Several such methods are described by Harlow, Antibodies, Cold Spring Harbor Press, (1989).

The term "monoclonal antibody" as used herein refers to an antibody obtained from a population of substantially homogeneous antibodies, i.e., the individual antibodies comprising the population are identical except for possible naturally occurring mutations that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In additional to their specificity, the monoclonal antibodies are advantageous in that they are synthesized by the hybridoma culture, uncontaminated by other immunoglobulins. The modifier "monoclonal" antibody indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler and Milstein, Nature 256, 495 (1975), or may be made by recombinant methods, e.g., as described in U.S. Pat. No. 4,816,567. The monoclonal antibodies for use with the present invention may also be isolated from phage antibody libraries using the techniques described in Clackson et al., Nature 352: 624-628 (1991), as well as in Marks et al., J. Mol. Biol. 222: 581-597 (1991). For detailed procedures for making a monoclonal antibody, see the Example below.

"Humanized" forms of non-human (e.g. murine or rabbit) antibodies are chimeric immunoglobulins, immunoglobulin chains or fragments thereof (such as Fv, Fab, Fab', F(ab').sub.2 or other antigen-binding subsequences of antibodies) which contain minimal sequence derived from non-human immunoglobulin. For the most part, humanized antibodies are human immunoglobulins (recipient antibody) in which residues from a complementary determining region (CDR) of the recipient are replaced by residues from a CDR of a non-human species (donor antibody) such as mouse, rat or rabbit having the desired specificity, affinity and capacity. In some instances, Fv framework residues of the human immunoglobulin are replaced by corresponding non-human residues. Furthermore, humanized antibody may comprise residues, which are found neither in the recipient antibody nor in the imported CDR or framework sequences. These modifications are made to further refine and optimize antibody performance. In general, the humanized antibody will comprise substantially all of at least one, and typically two, variable domains, in which all or substantially all of the CDR regions correspond to those of a non-human immunoglobulin and all or substantially all of the FR regions are those of a human immunoglobulin consensus sequence. The humanized antibody optimally also will comprise at least a portion of an immunoglobulin constant region (Fc), typically that of a human immunoglobulin. For further details, see: Jones et al., Nature 321, 522-525 (1986); Reichmann et al., Nature 332, 323-327 (1988) and Presta, Curr. Op. Struct. Biol. 2, 593-596 (1992).

Polyclonal antibodies may be prepared by any known method or modifications of these methods including obtaining antibodies from patients. For example, a complex of an immunogen such as PCAT proteins, peptides or fragments thereof and a carrier protein is prepared and an animal is immunized by the complex according to the same manner as that described with respect to the above monoclonal antibody preparation and the description in the Example. A serum or plasma containing the antibody against the protein is recovered from the immunized animal and the antibody is separated and purified. The gamma globulin fraction or the IgG antibodies can be obtained, for example, by use of saturated ammonium sulfate or DEAE Sephadex, or other techniques known to those skilled in the art.

The antibody titer in the antiserum can be measured according to the same manner as that described above with respect to the supernatant of the hybridoma culture. Separation and purification of the antibody can be carried out according to the same separation and purification method of antibody as that described with respect to the above monoclonal antibody and in the Example.

The protein used herein as the immunogen is not limited to any particular type of immunogen. In one aspect, antibodies are preferably prepared from regions or discrete fragments of the PCAT proteins. Antibodies can be prepared from any region of the peptide as described herein. In particular, they are selected from a group consisting of SEQ ID NOS: 703-873 and fragments of SEQ ID NOS: 1-288. An antigenic fragment will typically comprise at least 8 contiguous amino acid residues. The antigenic peptide can comprise, however, at least 10, 12, 14, 16 or more amino acid residues. Such fragments can be selected on a physical property, such as fragments correspond to regions that are located on the surface of the protein, e.g., hydrophilic regions or can be selected based on sequence uniqueness.

Antibodies may also be produced by inducing production in the lymphocyte population or by screening antibody libraries or panels of highly specific binding reagents as disclosed in Orlandi et al. (1989; Proc Natl Acad Sci 86: 3833-3837) or Winter et al. (1991; Nature 349: 293-299). A protein may be used in screening assays of phagemid or B-lymphocyte immunoglobulin libraries to identify antibodies having a desired specificity. Numerous protocols for competitive binding or immunoassays using either polyclonal or monoclonal antibodies with established specificities are well known in the art. Smith G. P., 1991, Curr. Opin. Biotechnol. 2: 668-673.

The antibodies of the present invention can also be generated using various phage display methods known in the art. In phage display methods, functional antibody domains are displayed on the surface of phage particles which carry the polynucleotide sequences encoding them. In a particular, such phage can be utilized to display antigen-binding domains expressed from a repertoire or combinatorial antibody library (e.g., human or murine). Phage expressing an antigen binding domain that binds the antigen of interest can be selected or identified with antigen, e.g., using labeled antigen or antigen bound or captured to a solid surface or bead. Phage used in these methods are typically filamentous phage including fd and M13 binding domains expressed from phage with Fab, Fv or disulfide stabilized Fv antibody domains recombinantly fused to either the phage gene III or gene VIII protein. Examples of phage display methods that can be used to make the antibodies of the present invention include those disclosed in Brinkman et al., J. Immunol Methods 182: 41-50 (1995); Ames et al., J. Immunol. Methods 184: 177-186 (1995); Kettleborough et al., Eur. J. Immunol. 24: 952-958 (1994); Persic et al., Gene 187 9-18 (1997); Burton et al., Advances in Immunology 57: 191-280 (1994); PCT application No. PCT/GB91/01134; PCT publications WO 90/02809; WO 91/10737; WO 92/01047; WO 92/18619; WO 93/11236; WO 95/15982; WO 95/20401; and U.S. Pat. Nos. 5,698,426; 5,223,409; 5,403,484; 5,580,717; 5,427,908; 5,750,753; 5,821,047; 5,571,698; 5,427,908; 5,516,637; 5,780,225; 5,658,727; 5,733,743 and 5,969,108; each of which is incorporated herein by reference in its entirety.

Antibody can be also made recombinantly. When using recombinant techniques, the antibody variant can be produced intracellularly, in the periplasmic space, or directly secreted into the medium. If the antibody variant is produced intracellularly, as a first step, the particulate debris, either host cells or lysed fragments, is removed, for example, by centrifugation or ultrafiltration. Carter et al., Bio/Technology 10: 163-167 (1992) describe a procedure for isolating antibodies which are secreted to the periplasmic space of *E. coli*. Briefly, cell paste is thawed in the presence of sodium acetate (pH 3.5), EDTA, and phenylmethylsulfonylfluoride (PMSF) over about 30 minutes. Cell debris can be removed by centrifugation. Where the antibody variant is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibodies or antigen binding fragments may also be produced by genetic engineering. The technology for expression of both heavy and light cain genes in *E. coli* is the subject the following PCT patent applications; publication number WO 901443, WO901443, and WO 9014424 and in Huse et al., 1989 Science 246: 1275-1281. The general recombinant methods are well known in the art.

The antibody composition prepared from the cells can be purified using, for example, hydroxylapatite chromatography, gel electrophoresis, dialysis, and affinity chromatography, with affinity chromatography being the preferred purification technique. The suitability of protein A as an affinity ligand depends on the species and isotype of any immunoglobulin Fc domain that is present in the antibody. Protein A can be used to purify antibodies that are based on human delta. 1, .delta.2 or .delta.4 heavy chains (Lindmark et al., J. Immunol Meth. 62: 1-13 (1983)). Protein G is recommended for all mouse isotypes and for human .delta.3 (Guss et al., EMBO J. 5: 1567-1575 (1986)). The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody comprises a CH3 domain, the Bakerbond ABX™ resin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromatofocusing, SDS-PAGE, and ammonium sulfate precipitation are also available depending on the antibody to be recovered.

Following any preliminary purification step(s), the mixture comprising the antibody of interest and contaminants may be subjected to low pH hydrophobic interaction chromatography using an elution buffer at a pH between about 2.5-4.5, preferably performed at low salt concentrations (e.g., from about 0-0.25M salt).

Antibody Uses

The antibodies can be used to isolate one of the proteins of the present invention by standard techniques, such as affinity chromatography or immunoprecipitation. The antibodies can facilitate the purification of the natural protein from cells and recombinantly produced protein expressed in host cells. In addition, such antibodies are useful to detect the presence of one of the proteins of the present invention in cells or tissues to determine the pattern of expression of the protein among various tissues in an organism and over the course of normal development. Experimental data as provided in Table 1 indicate that the PCATs of the present invention are expressed at differential level in various pancreatic cell lines, for example SEQ ID NOS: 1-119 are overexpressed in all tested cell lines, whereas other proteins or peptides are underexpressed in selected cell lines. In one example, protein (SEQ ID NO: 120) or peptide (SEQ ID NO: 761) is overexpressed in one cell line (HPAC), yet underexpressed in another cell line (Su.86.86). Further, such antibodies can be used to detect protein in situ, in vitro, or in a cell lysate or supernatant in order to evaluate the abundance and pattern of expression. Also, such antibodies can be used to assess abnormal tissue distribution or abnormal expression during development or progression of a biological condition. Antibody detection of circulating fragments of the full length protein can be used to identify turnover.

Further, the antibodies can be used to assess expression in disease states such as in active stages of the disease or in an individual with a predisposition toward disease related to the protein's function. When a disorder is caused by an inappropriate tissue distribution, developmental expression, level of expression of the protein, or expressed/processed form, the antibody can be prepared against the normal protein. Experimental data as provided in Table 1 indicates expression in human pancreatic cell lines. If a disorder is characterized by a specific mutation in the protein, antibodies specific for this mutant protein can be used to assay for the presence of the specific mutant protein.

The antibodies can also be used to assess normal and aberrant subcellular localization of cells in the various tissues in an organism. Experimental data as provided in Table 1 indicates expression in human pancreatic cell lines. The diagnostic uses can be applied, not only in genetic testing, but also in monitoring a treatment modality. Accordingly, where treatment is ultimately aimed at correcting expression level or the presence of aberrant sequence and aberrant tissue distribution or developmental expression, antibodies directed against the protein or relevant fragments can be used to monitor therapeutic efficacy. More detection and diagnostic methods are described in detail below.

Additionally, antibodies are useful in pharmacogenomic analysis. Thus, antibodies prepared against polymorphic proteins can be used to identify individuals that require modified treatment modalities. The antibodies are also useful as diagnostic tools, as an immunological marker for aberrant protein analyzed by electrophoretic mobility, isoelectric point, tryptic peptide digest, and other physical assays known to those in the art.

The antibodies are also useful for tissue typing. Experimental data as provided in Table 1 indicates expression in human pancreatic cell lines. Thus, where a specific protein has been correlated with expression in a specific tissue, antibodies that are specific for this protein can be used to identify a tissue type.

The antibodies are also useful for inhibiting protein function, for example, blocking the binding of the PCAT peptide to a binding partner such as a substrate or another antibody binding to the PCAT. These uses can also be applied in a therapeutic context in which treatment involves inhibiting the protein's function. An antibody can be used, for example, to block binding, thus modulating (agonizing or antagonizing) the peptides activity. Antibodies can be prepared against specific fragments containing sites required for function or against intact protein that is associated with a cell or cell membrane. More therapeutics methods are described in detail below.

The invention also encompasses kits for using antibodies to detect the presence of a protein in a biological sample. The kit can comprise antibodies such as a labeled or labelable antibody and a compound or agent for detecting protein in a biological sample; means for determining the amount of protein in the sample; means for comparing the amount of protein in the sample with a standard; and instructions for use. Such a kit can be supplied to detect a single protein or epitope or can be configured to detect one of a multitude of epitopes, such as in an antibody detection array. Arrays are described in detail below for nucleic acid arrays and similar methods have been developed for antibody arrays.

Nucleic Acid Molecules

The present invention further provides isolated nucleic acid molecules that encode a PCAT peptide or protein of the present invention. Such nucleic acid molecules will consist of, consist essentially of, or comprise a nucleotide sequence that encodes one of the PCAT peptides of the present invention, an allelic variant thereof, or an ortholog or paralog thereof. The nucleic acid molecules and the fragments thereof of the present invention pertains, however, are not to be construed as encompassing fragments that may be disclosed publicly prior to the present invention.

As used herein, an "isolated" nucleic acid molecule is one that is separated from other nucleic acid present in the natural source of the nucleic acid. Preferably, an "isolated" nucleic acid is free of sequences which naturally flank the nucleic acid (i.e., sequences located at the 5' and 3' ends of the nucleic acid) in the genomic DNA of the organism from which the nucleic acid is derived. However, there can be some flanking nucleotide sequences, for example up to about 5 KB, 4 KB, 3 KB, 2 KB, or 1 KB or less, particularly contiguous peptide encoding sequences and peptide encoding sequences within the same gene but separated by introns in the genomic sequence. The important point is that the nucleic acid is isolated from remote and unimportant flanking sequences such that it can be subjected to the specific manipulations described herein such as recombinant expression, preparation of probes and primers, and other uses specific to the nucleic acid sequences.

Moreover, an "isolated" nucleic acid molecule, such as a transcript/cDNA molecule, can be substantially free of other cellular material, or culture medium when produced by recombinant techniques, or chemical precursors or other chemicals when chemically synthesized. However, the nucleic acid molecule can be fused to other coding or regulatory sequences and still be considered isolated.

For example, recombinant DNA molecules contained in a vector are considered isolated. Further examples of isolated DNA molecules include recombinant DNA molecules maintained in heterologous host cells or purified (partially or substantially) DNA molecules in solution. Isolated RNA molecules include in vivo or in vitro RNA transcripts of the isolated DNA molecules of the present invention. Isolated nucleic acid molecules according to the present invention further include such molecules produced synthetically.

The present invention further provides nucleic acid molecules that comprise the nucleotide sequences shown in Table 2, (SEQ ID NOS: 289-702), or any nucleic acid molecule that encodes the protein provided in Table 2, (SEQ ID NOS: 1-288). A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleic acid residues, such as nucleic acid residues that are naturally associated with it or heterologous nucleotide sequences. Such a nucleic acid molecule can have a few additional nucleotides or can comprise several hundred or more additional nucleotides. A brief description of how various types of these nucleic acid molecules can be readily made/isolated is provided below.

In Table 2, human transcript sequences are provided. As discussed below, some of the non-coding regions, particularly gene regulatory elements such as promoters, are useful for a variety of purposes, e.g. control of heterologous gene expression, target for identifying gene activity modulating compounds, and are particularly claimed as fragments of the genomic sequence provided herein.

The isolated nucleic acid molecules can encode the mature protein plus additional amino or carboxyl-terminal amino acids, or amino acids interior to the mature peptide (when the mature form has more than one peptide chain, for instance). Such sequences may play a role in processing of a protein from precursor to a mature form, facilitate protein trafficking, prolong or shorten protein half-life or facilitate manipulation of a protein for assay or production, among other things. As generally is the case in situ, the additional amino acids may be processed away from the mature protein by cellular enzymes.

As mentioned above, the isolated nucleic acid molecules include, but are not limited to, the sequence encoding the PCAT peptide alone, the sequence encoding the mature peptide and additional coding sequences, such as a leader or secretory sequence (e.g., a pre-pro or pro-protein sequence), the sequence encoding the mature peptide, with or without the additional coding sequences, plus additional non-coding sequences, for example introns and non-coding 5' and 3' sequences such as transcribed but non-translated sequences that play a role in transcription, mRNA processing (including splicing and polyadenylation signals), ribosome binding and stability of mRNA. In addition, the nucleic acid molecule may be fused to a marker sequence encoding, for example, a peptide that facilitates purification.

Isolated nucleic acid molecules can be in the form of RNA, such as mRNA, or in the form DNA, including cDNA and genomic DNA obtained by cloning or produced by chemical synthetic techniques or by a combination thereof. The nucleic acid, especially DNA, can be double-stranded or single-stranded. Single-stranded nucleic acid can be the coding strand (sense strand) or the non-coding strand (anti-sense strand).

The invention further provides nucleic acid molecules that encode fragments of the peptides of the present invention as well as nucleic acid molecules that encode obvious variants of the PCAT proteins of the present invention that are described above. Such nucleic acid molecules may be naturally occurring, such as allelic variants (same locus), paralogs (different locus), and orthologs (different organism), or may be constructed by recombinant DNA methods or by chemical synthesis. Such non-naturally occurring variants may be made by mutagenesis techniques, including those applied to nucleic acid molecules, cells, or organisms. Accordingly, as discussed above, the variants can contain nucleotide substitutions, deletions, inversions and insertions. Variation can occur in either or both the coding and non-coding regions. The variations can produce both conservative and non-conservative amino acid substitutions.

The present invention further provides non-coding fragments of the nucleic acid molecules provided in Tables 1 and 2. Preferred non-coding fragments include, but are not limited to, promoter sequences, enhancer sequences, gene modulating sequences and gene termination sequences. Such fragments are useful in controlling heterologous gene expression and in developing screens to identify gene-modulating agents. A promoter can readily be identified as being 5' to the ATG start site in the genomic sequence.

A fragment comprises a contiguous nucleotide sequence greater than 12 or more nucleotides. Further, a fragment could at least 30, 40, 50, 100, 250 or 500 nucleotides in length. The length of the fragment will be based on its intended use. For example, the fragment can encode epitope bearing regions of the peptide, or can be useful as DNA probes and primers. Such fragments can be isolated using the known nucleotide sequence to synthesize an oligonucleotide probe. A labeled probe can then be used to screen a cDNA library, genomic DNA library, or mRNA to isolate nucleic acid corresponding to the coding region. Further, primers can be used in PCR reactions to clone specific regions of the gene.

A probe/primer typically comprises substantially a purified oligonucleotide or oligonucleotide pair. The oligonucleotide typically comprises a region of nucleotide sequence that hybridizes under stringent conditions to at least about 12, 20, 25, 40, 50 or more consecutive nucleotides.

Orthologs, homologs, and allelic variants can be identified using methods well known in the art. As described in the Peptide Section, these variants comprise a nucleotide sequence encoding a peptide that is typically 60-70%, 70-80%, 80-90%, and more typically at least about 90-95% or more homologous to the nucleotide sequence shown in the Table 2 or a fragment of this sequence. Such nucleic acid molecules can readily be identified as being able to hybridize under moderate to stringent conditions, to the nucleotide sequence shown in the Figure sheets or a fragment of the sequence. Allelic variants can readily be determined by genetic locus of the encoding gene.

As used herein, the term "hybridizes under stringent conditions" is intended to describe conditions for hybridization and washing under which nucleotide sequences encoding a peptide at least 60-70% homologous to each other typically remain hybridized to each other. The conditions can be such that sequences at least about 60%, at least about 70%, or at least about 80% or more homologous to each other typically remain hybridized to each other. Such stringent conditions are known to those skilled in the art and can be found in Current Protocols in Molecular Biology, John Wiley & Sons, N.Y. (1989), 6.3.1-6.3.6. One example of stringent hybridization conditions is hybridization in 6× sodium chloride/sodium citrate (SSC) at about 45 C, followed by one or more washes in 0.2×SSC, 0.1% SDS at 50-65 C. Examples of moderate to low stringency hybridization conditions are well known in the art.

Nucleic Acid Molecule Uses

The nucleic acid molecules of the present invention are useful for probes, primers, chemical intermediates, and in biological assays. The nucleic acid molecules are useful as a hybridization probe for messenger RNA, transcript/cDNA and genomic DNA to isolate full-length cDNA and genomic clones encoding the peptide described in Tables 1 and 2 and to isolate cDNA and genomic clones that correspond to variants (alleles, orthologs, etc.) producing the same or related peptides shown in Tables 1 and 2.

The probe can correspond to any sequence along the entire length of the nucleic acid molecules provided in the Tables. Accordingly, it could be derived from. 5' noncoding regions, the coding region, and 3' noncoding regions. However, as discussed, fragments are not to be construed as encompassing fragments disclosed prior to the present invention.

The nucleic acid molecules are also useful as primers for PCR to amplify any given region of a nucleic acid molecule and are useful to synthesize antisense molecules of desired length and sequence.

The nucleic acid molecules are also useful for constructing recombinant vectors. Such vectors include expression vectors that express a portion of, or all of, the peptide sequences. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced mutations.

The nucleic acid molecules are also useful for expressing antigenic portions of the proteins.

The nucleic acid molecules are also useful as probes for determining the chromosomal positions of the nucleic acid molecules by means of in situ hybridization methods.

The nucleic acid molecules are also useful in making vectors containing the gene regulatory regions of the nucleic acid molecules of the present invention.

The nucleic acid molecules are also useful for designing ribozymes corresponding to all, or a part, of the mRNA produced from the nucleic acid molecules described herein.

The nucleic acid molecules are also useful for making vectors that express part, or all, of the peptides.

The nucleic acid molecules are also useful for constructing host cells expressing a part, or all, of the nucleic acid molecules and peptides.

The nucleic acid molecules are also useful for constructing transgenic animals expressing all, or a part, of the nucleic acid molecules and peptides.

The nucleic acid molecules are also useful as hybridization probes for determining the presence, level, form and distribution of nucleic acid expression. Experimental data as provided in Table 1 indicate that the PCATs of the present invention are expressed at differential level in various pancreatic cell lines, for example SEQ ID NOS: 1-119 are overexpressed in all tested cell lines, whereas other proteins or peptides are underexpressed in selected cell lines. In one example, protein (SEQ ID NO: 120) or peptide (SEQ ID NO: 761) is overexpressed in one cell line (HPAC), yet underexpressed in another cell line (Su.86.86). Accordingly, the probes can be used to detect the presence of, or to determine levels of, a specific nucleic acid molecule in cells, tissues, and in organisms. The nucleic acid whose level is determined can be DNA or RNA. Accordingly, probes corresponding to the peptides described herein can be used to assess expression and/or gene copy number in a given cell, tissue, or organism. These uses are relevant for diagnosis of disorders involving an increase or decrease in PCAT protein expression relative to normal results.

In vitro techniques for detection of mRNA include Northern hybridizations and in situ hybridizations. In vitro techniques for detecting DNA include Southern hybridizations and in situ hybridization.

Probes can be used as a part of a diagnostic test kit for identifying cells or tissues that express a PCAT protein, such as by measuring a level of a PCAT-encoding nucleic acid in a sample of cells from a subject e.g., mRNA or genomic DNA, or determining if a PCAT gene has been mutated. Experimental data as provided in Table 1 indicate that the PCATs of the present invention are expressed at differential level in various pancreatic cell lines, for example SEQ ID NOS: 1-119 are overexpressed in all tested cell lines, whereas other proteins or peptides are underexpressed in selected cell lines. In one example, protein (SEQ ID NO: 120) or peptide (SEQ ID NO: 761) is overexpressed in one cell line (HPAC), yet underexpressed in another cell line (Su.86.86). More detection and diagnostic methods are described in detail below.

Nucleic acid expression assays are useful for drug screening to identify compounds that modulate PCAT nucleic acid expression.

The invention thus provides a method for identifying a compound that can be used to treat a disorder associated with nucleic acid expression of the PCAT gene, particularly biological and pathological processes that are mediated by the PCAT in cells and tissues that express it. Experimental data as provided in Table 1 indicates expression in human pancreatic cell lines. The method typically includes assaying the ability of the compound to modulate the expression of the PCAT nucleic acid and thus identifying a compound that can be used to treat a disorder characterized by undesired PCAT nucleic acid expression. The assays can be performed in cell-based and cell-free systems. Cell-based assays include cells naturally expressing the PCAT nucleic acid or recombinant cells genetically engineered to express specific nucleic acid sequences.

The assay for PCAT nucleic acid expression can involve direct assay of nucleic acid levels, such as mRNA levels, or on collateral compounds involved in the signal pathway. Further, the expression of genes that are up- or down-regulated in response to the PCAT protein signal pathway can also be assayed. In this embodiment the regulatory regions of these genes can be operably linked to a reporter gene such as luciferase.

Thus, modulators of PCAT gene expression can be identified in a method wherein a cell is contacted with a candidate compound or agent and the expression of mRNA determined. The level of expression of PCAT mRNA in the presence of the candidate compound or agent is compared to the level of expression of PCAT mRNA in the absence of the candidate compound or agent. The candidate compound can then be identified as a modulator of nucleic acid expression based on this comparison and be used, for example to treat a disorder characterized by aberrant nucleic acid expression. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the nucleic acid as a target, using a compound or an agent identified through drug screening as a gene modulator to modulate PCAT nucleic acid expression in cells and tissues that express the PCAT. Experimental data as provided in Table 1 indicate that the PCATs of the present invention are expressed at differential level in various pancreatic cell lines, for example SEQ ID NOS: 1-119 are overexpressed in all tested cell lines, whereas other proteins or peptides are underexpressed in selected cell lines. In one example, protein (SEQ ID NO: 120) or peptide (SEQ ID NO: 761) is overexpressed in one cell line (HPAC), yet underexpressed in another cell line (Su.86.86). Modulation includes both up-regulation (i.e. activation or agonization) or down-regulation (suppression or antagonization) or nucleic acid expression.

Alternatively, a modulator for nucleic acid expression can be a small molecule or drug identified using the screening assays described herein as long as the drug or small molecule inhibits the PCAT nucleic acid expression in the cells and tissues that express the protein. Experimental data as provided in Table 1 indicates expression in human pancreatic cell lines.

The nucleic acid molecules are also useful for monitoring the effectiveness of modulating compounds or agents on the expression or activity of the PCAT gene in clinical trials or in a treatment regimen. Thus, the gene expression pattern can serve as a barometer for the continuing effectiveness of treatment with the compound, particularly with compounds to which a patient can develop resistance. The gene expression pattern can also serve as a marker indicative of a physiological response of the affected cells to the compound. Accordingly, such monitoring would allow either increased administration of the compound or the administration of alternative compounds to which the patient has not become resistant. Similarly, if the level of nucleic acid expression falls below a desirable level, administration of the compound could be commensurately decreased.

The nucleic acid molecules are also useful in diagnostic assays for qualitative changes in PCAT nucleic acid expression, and particularly in qualitative changes that lead to pathology. The nucleic acid molecules can be used to detect mutations in PCAT genes and gene expression products such as mRNA. The nucleic acid molecules can be used as hybridization probes to detect naturally occurring genetic mutations in the PCAT gene and thereby to determine whether a subject with the mutation is at risk for a disorder caused by the mutation. Mutations include deletion, addition, or substitution of one or more nucleotides in the gene, chromosomal rearrangement, such as inversion or transposition, modification of genomic DNA, such as aberrant methylation patterns or changes in gene copy number, such as amplification Detection of a mutated form of the PCAT gene associated with a dysfunction provides a diagnostic tool for an active disease or susceptibility to disease when the disease results from overexpression, underexpression, or altered expression of a PCAT protein.

Individuals carrying mutations in the PCAT gene can be detected at the nucleic acid level by a variety of techniques. Genomic DNA can be analyzed directly or can be amplified by using PCR prior to analysis. RNA or cDNA can be used in the same way. In some uses, detection of the mutation involves the use of a probe/primer in a polymerase chain reaction (PCR) (see, e.g. U.S. Pat. Nos. 4,683,195 and 4,683,202), such as anchor PCR or RACE PCR, or, alternatively, in a ligation chain reaction (LCR) (see, e.g., Landegran et al., Science 241: 1077-1080 (1988); and Nakazawa et al., PNAS 91: 360-364 (1994)), the latter of which can be particularly useful for detecting point mutations in the gene (see Abravaya et al., Nucleic Acids Res. 23: 675-682 (1995)). This method can include the steps of collecting a sample of cells from a patient, isolating nucleic acid (e.g., genomic, mRNA or both) from the cells of the sample, contacting the nucleic acid sample with one or more primers which specifically hybridize to a gene under conditions such that hybridization and amplification of the gene (if present) occurs, and detecting the presence or absence of an amplification product, or detecting the size of the amplification product and comparing the length to a control sample. Deletions and insertions can be detected by a change in size of the amplified product compared to the normal genotype. Point mutations can be identified by hybridizing amplified DNA to normal RNA or antisense DNA sequences.

Alternatively, mutations in a PCAT gene can be directly identified, for example, by alterations in restriction enzyme digestion patterns determined by gel electrophoresis.

Further, sequence-specific ribozymes (U.S. Pat. No. 5,498, 531) can be used to score for the presence of specific mutations by development or loss of a ribozyme cleavage site. Perfectly matched sequences can be distinguished from mismatched sequences by nuclease cleavage digestion assays or by differences in melting temperature.

Sequence changes at specific locations can also be assessed by nuclease protection assays such as RNase and S1 protection or the chemical cleavage method. Furthermore, sequence differences between a mutant PCAT gene and a wild-type gene can be determined by direct DNA sequencing. A variety of automated sequencing procedures can be utilized when performing the diagnostic assays (Naeve, C. W., (1995) Biotechniques 19: 448), including sequencing by mass spectrometry (see, e.g., PCT International Publication No. WO 94/16101; Cohen et al., Adv. Chromatogr. 36: 127-162 (1996); and Griffin et al., Appl. Biochem. Biotechnol. 38: 147-159 (1993)).

Other methods for detecting mutations in the gene include methods in which protection from cleavage agents is used to detect mismatched bases in RNA/RNA or RNA/DNA duplexes (Myers et al., Science 230: 1242 (1985)); Cotton et al., PNAS 85: 4397 (1988); Saleeba et al., Meth. Enzymol. 217: 286-295 (1992)), electrophoretic mobility of mutant and wild type nucleic acid is compared (Orita et al., PNAS 86: 2766 (1989); Cotton et al., Mutat. Res. 285: 125-144 (1993); and Hayashi et al., Genet. Anal. Tech. Appl. 9: 73-79 (1992)), and movement of mutant or wild-type fragments in polyacrylamide gels containing a gradient of denaturant is assayed using denaturing gradient gel electrophoresis (Myers et al., Nature 313: 495 (1985)). Examples of other techniques for detecting point mutations include selective oligonucleotide hybridization, selective amplification, and selective primer extension.

The nucleic acid molecules are also useful for testing an individual for a genotype that while not necessarily causing the disease, nevertheless affects the treatment modality. Thus, the nucleic acid molecules can be used to study the relationship between an individual's genotype and the individual's response to a compound used for treatment (pharmacogenomic relationship). Accordingly, the nucleic acid molecules described herein can be used to assess the mutation content of the PCAT gene in an individual in order to select an appropriate compound or dosage regimen for treatment.

Thus nucleic acid molecules displaying genetic variations that affect treatment provide a diagnostic target that can be used to tailor treatment in an individual. Accordingly, the production of recombinant cells and animals containing these polymorphisms allow effective clinical design of treatment compounds and dosage regimens.

The nucleic acid molecules are thus useful as antisense constructs to control PCAT gene expression in cells, tissues, and organisms. A DNA antisense nucleic acid molecule is designed to be complementary to a region of the gene involved in transcription, preventing transcription and hence production of PCAT protein. An antisense RNA or DNA nucleic acid molecule would hybridize to the mRNA and thus block translation of mRNA into PCAT protein.

The nucleic acid of the present invention may also be used to specifically suppress gene expression by methods such as RNA interference (RNAi), which may also include cosuppression and quelling. This and antisense RNA or DNA of gene suppression are well known in the art. A review of this technique is found in Science 288: 1370-1372, 2000. RNAi also operates on a post-transcriptional level and is sequence specific, but suppresses gene expression far more efficiently than antisense RNA. RNAi fragments, particularly double-stranded (ds) RNAi, can be also used to generate loss-of-function phenotypes.

Alternatively, a class of antisense molecules can be used to inactivate mRNA in order to decrease expression of PCAT nucleic acid. Accordingly, these molecules can treat a disorder characterized by abnormal or undesired PCAT nucleic acid expression. This technique involves cleavage by means of ribozymes containing nucleotide sequences complementary to one or more regions in the mRNA that attenuate the ability of the mRNA to be translated. Possible regions include coding regions and particularly coding regions corresponding to the catalytic and other functional activities of the PCAT protein, such as substrate binding.

The nucleic acid molecules also provide vectors for gene therapy in patients containing cells that are aberrant in PCAT gene expression. Thus, recombinant cells, which include the patient's cells that have been engineered ex vivo and returned to the patient, are introduced into an individual where the cells produce the desired PCAT protein to treat the individual.

The invention also encompasses kits for detecting the presence of a PCAT nucleic acid in a biological sample. Experimental data as provided in Table 1 indicate that the PCATs of the present invention are expressed at differential level in various pancreatic cell lines, for example SEQ ID NOS: 1-119 are overexpressed in all tested cell lines, whereas other proteins or peptides are underexpressed in selected cell lines. In one example, protein (SEQ ID NO: 120) or peptide (SEQ ID NO: 761) is overexpressed in one cell line (HPAC), yet underexpressed in another cell line (Su.86.86). For example, the kit can comprise reagents such as a labeled or labelable nucleic acid or agent capable of detecting PCAT nucleic acid in a biological sample; means for determining the amount of PCAT nucleic acid in the sample; and means for comparing the amount of PCAT nucleic acid in the sample with a standard. The compound or agent can be packaged in a suitable container. The kit can further comprise instructions for using the kit to detect PCAT protein mRNA or DNA.

Vectors/Host Cells

The invention also provides vectors containing the nucleic acid molecules described herein. The term "vector" refers to a vehicle, preferably a nucleic acid molecule, which can transport the nucleic acid molecules. When the vector is a nucleic acid molecule, the nucleic acid molecules are covalently linked to the vector nucleic acid. With this aspect of the invention, the vector includes a plasmid, single or double stranded phage, a single or double stranded RNA or DNA viral vector, or artificial chromosome, such as a BAC, PAC, YAC, OR MAC.

A vector can be maintained in the host cell as an extrachromosomal element where it replicates and produces additional copies of the nucleic acid molecules. Alternatively, the vector may integrate into the host cell genome and produce additional copies of the nucleic acid molecules when the host cell replicates.

The invention provides vectors for the maintenance (cloning vectors) or vectors for expression (expression vectors) of the nucleic acid molecules. The vectors can function in prokaryotic or eukaryotic cells or in both (shuttle vectors).

Expression vectors contain cis-acting regulatory regions that are operably linked in the vector to the nucleic acid molecules such that transcription of the nucleic acid molecules is allowed in a host cell. The nucleic acid molecules can be introduced into the host cell with a separate nucleic acid molecule capable of affecting transcription. Thus, the second nucleic acid molecule may provide a trans-acting factor interacting with the cis-regulatory control region to allow transcription of the nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the nucleic acid molecules described herein can be operably linked include promoters for directing mRNA transcription. These include, but are not limited to, the left promoter from bacteriophage, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region a ribosome binding site for translation. Other regulatory control elements for expression include initiation and termination codons as well as polyadenylation signals. The person of ordinary skill in the art would be aware of the numerous regulatory sequences that are useful in expression vectors. Such regulatory sequences are described, for example, in Sambrook et al., Molecular Cloning: A Laboratory Manual. 3rd. ed., Cold Spring Harbor Laboratory Press, Cold Spring Harbor, N.Y., (2001).

A variety of expression vectors can be used to express a nucleic acid molecule. Such vectors include chromosomal, episomal, and virus-derived vectors, for example vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors may also be derived from combinations of these sources such as those derived from plasmid and bacteriophage genetic elements, e.g. cosmids and phagemids. Appropriate cloning and expression vectors for prokaryotic and eukaryotic hosts are described in Sambrook et al., Molecular Cloning: A Laboratory Manual. 3rd. ed., Cold Spring Harbor Laboratory Press, Cold Spring Harbor, N.Y., (2001).

The regulatory sequence may provide constitutive expression in one or more host cells (i.e. tissue specific) or may provide for inducible expression in one or more cell types such as by temperature, nutrient additive, or exogenous factor such as a hormone or other ligand. A variety of vectors providing for constitutive and inducible expression in prokaryotic and eukaryotic hosts are well known to those of ordinary skill in the art.

The nucleic acid molecules can be inserted into the vector nucleic acid by well-known methodologies. Generally, the DNA sequence that will ultimately be expressed is joined to an expression vector by cleaving the DNA sequence and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial cells include, but are not limited to, *E. coli, Streptomyces*, and *Salmonella typhimurium*. Eukaryotic cells include, but are not limited to, yeast, insect cells such as *Drosophila*, animal cells such as COS and CHO cells, and plant cells.

As described herein, it may be desirable to express the peptide as a fusion protein. Accordingly, the invention provides fusion vectors that allow for the production of the peptides. Fusion vectors can increase the expression of a recombinant protein; increase the solubility of the recombinant protein, and aid in the purification of the protein by acting for example as a ligand for affinity purification. A proteolytic cleavage site may be introduced at the junction of the fusion moiety so that the desired peptide can ultimately be separated from the fusion moiety. Proteolytic enzymes include, but are not limited to, factor Xa, thrombin, and enteroenzyme. Typical fusion expression vectors include pGEX (Smith et al., Gene 67: 31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., Gene 69: 301-315 (1988)) and pET 11d (Studier et al., Gene Expression Technology: Methods in Enzymology 185: 60-89 (1990)). Recombinant protein expression can be maximized in host bacteria by providing a genetic background wherein the host cell has an impaired capacity to proteolytically cleave the recombinant protein. (Gottesman, S., Gene Expression Technology: Methods in Enzymology 185, Academic Press, San Diego, Calif. (1990) 119-128). Alternatively, the sequence of the nucleic acid molecule of interest can be altered to provide preferential codon usage for a specific host cell, for example *E. coli*. (Wada et al., Nucleic Acids Res. 20: 2111-2118 (1992)).

The nucleic acid molecules can also be expressed by expression vectors that are operative in yeast. Examples of vectors for expression in yeast e.g., *S. cerevisiae* include pYepSec1 (Baldari, et al., EMBO J. 6: 229-234 (1987)), pMFa (Kurjan et al., Cell 30: 933-943 (1982)), pJRY88 (Schultz et al., Gene 54: 113-123 (1987)), and pYES2 (Invitrogen Corporation, San Diego, Calif.).

The nucleic acid molecules can also be expressed in insect cells using, for example, baculovirus expression vectors. Baculovirus vectors available for expression of proteins in cultured insect cells (e.g., Sf 9 cells) include the pAc series (Smith et al., Mol. Cell Biol. 3: 2156-2165 (1983)) and the pVL series (Lucklow et al., Virology 170: 31-39 (1989)).

In certain embodiments of the invention, the nucleic acid molecules described herein are expressed in mammalian cells using mammalian expression vectors. Examples of mammalian expression vectors include pCDM8 (Seed, B. Nature 329: 840 (1987)) and pMT2PC (Kaufman et al., EMBO J. 6: 187-195 (1987)).

The expression vectors listed herein are provided by way of example only of the well-known vectors available to those of ordinary skill in the art that would be useful to express the nucleic acid molecules. The person of ordinary skill in the art would be aware of other vectors suitable for maintenance propagation or expression of the nucleic acid molecules described herein. These are found for example in Sambrook, J., Fritsh, E. F., and Maniatis, T. Molecular Cloning: A Laboratory Manual. 3rd, ed., Cold Spring Harbor Laboratory, Cold Spring Harbor Laboratory Press, Cold Spring Harbor, N.Y., 2001.

The invention also encompasses vectors in which the nucleic acid sequences described herein are cloned into the vector in reverse orientation, but operably linked to a regulatory sequence that permits transcription of antisense RNA. Thus, an antisense transcript can be produced to all, or to a portion, of the nucleic acid molecule sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include prokaryotic cells, lower eukaryotic cells such as yeast, other eukaryotic cells such as insect cells, and higher eukaryotic cells such as mammalian cells.

The recombinant host cells are prepared by introducing the vector constructs described herein into the cells by techniques readily available to the person of ordinary skill in the art. These include, but are not limited to, calcium phosphate transfection, DEAE-dextran-mediated transfection, cationic lipid-mediated transfection, electroporation, transduction, infection, lipofection, and other techniques such as those found in Sambrook, et al. (Molecular Cloning: A Laboratory Manual. 3rd, ed., Cold Spring Harbor Laboratory, Cold Spring Harbor Laboratory Press, Cold Spring Harbor, N.Y., 2001).

Host cells can contain more than one vector. Thus, different nucleotide sequences can be introduced on different vectors of the same cell. Similarly, the nucleic acid molecules can be introduced either alone or with other nucleic acid molecules that are not related to the nucleic acid molecules such as those providing trans-acting factors for expression vectors. When more than one vector is introduced into a cell, the vectors can be introduced independently, co-introduced or joined to the nucleic acid molecule vector.

In the case of bacteriophage and viral vectors, these can be introduced into cells as packaged or encapsulated virus by standard procedures for infection and transduction Viral vectors can be replication-competent or replication-defective. In the case in which viral replication is defective, replication will occur in host cells providing functions that complement the defects.

Vectors generally include selectable markers that enable the selection of the subpopulation of cells that contain the recombinant vector constructs. The marker can be contained in the same vector that contains the nucleic acid molecules described herein or may be on a separate vector. Markers include tetracycline or ampicillin-resistance genes for prokaryotic host cells and dihydrofolate reductase or neomycin resistance for eukaryotic host cells. However, any marker that provides selection for a phenotypic trait will be effective.

While the mature proteins can be produced in bacteria, yeast, mammalian cells, and other cells under the control of the appropriate regulatory sequences, cell-free transcription and translation systems can also be used to produce these proteins using RNA derived from the DNA constructs described herein.

Where secretion of the peptide is desired, which may be difficult to achieve with multi-transmembrane domain containing proteins such as PCATs, appropriate secretion signals are incorporated into the vector. The signal sequence can be endogenous to the peptides or heterologous to these peptides.

Where the peptide is not secreted into the medium, the protein can be isolated from the host cell by standard disruption procedures, including freeze thaw, sonication, mechanical disruption, use of lysing agents and the like. The peptide can then be recovered and purified by well-known purification methods including ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that depending upon the host cell in recombinant production of the peptides described herein, the peptides can have various glycosylation patterns, depending upon the cell, or maybe non-glycosylated as when produced in bacteria. In addition, the peptides may include an initial modified methionine in some cases as a result of a host-mediated process.

Uses of Vectors and Host Cells

The recombinant host cells expressing the peptides described herein have a variety of uses. First, the cells are useful for producing a PCAT protein or peptide that can be further purified to produce desired amounts of PCAT protein or fragments. Thus, host cells containing expression vectors are useful for peptide production.

Host cells are also useful for conducting cell-based assays involving the PCAT protein or PCAT protein fragments, such as those described above as well as other formats known in the art. Thus, a recombinant host cell expressing a native PCAT protein is useful for assaying compounds that stimulate or inhibit PCAT protein function.

Host cells are also useful for identifying PCAT protein mutants in which these functions are affected. If the mutants naturally occur and give rise to a pathology, host cells containing the mutations are useful to assay compounds that have a desired effect on the mutant PCAT protein (for example, stimulating or inhibiting function) which may not be indicated by their effect on the native PCAT protein.

Genetically engineered host cells can be further used to produce non-human transgenic animals. A transgenic animal is preferably a mammal, for example a rodent, such as a rat or mouse, in which one or more of the cells of the animal include a transgene. A transgene is exogenous DNA which is integrated into the genome of a cell from which a transgenic animal develops and which remains in the genome of the mature animal in one or more cell types or tissues of the transgenic animal. These animals are useful for studying the function of a PCAT protein and identifying and evaluating modulators of PCAT protein activity. Other examples of transgenic animals include non-human primates, sheep, dogs, cows, goats, chickens, and amphibians.

A transgenic animal can be produced by introducing nucleic acid into the male pronuclei of a fertilized oocyte, e.g., by microinjection, retroviral infection, and allowing the oocyte to develop in a pseudopregnant female foster animal. Any of the PCAT protein nucleotide sequences can be introduced as a transgene into the genome of a non-human animal, such as a mouse.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the PCAT protein to particular cells.

Methods for generating transgenic animals via embryo manipulation and microinjection, particularly animals such as mice, have become conventional in the art and are described, for example, in U.S. Pat. Nos. 4,736,866 and 4,870,009, both by Leder et al., U.S. Pat. No. 4,873,191 by Wagner et al. and in Hogan, B., Manipulating the Mouse Embryo, (Cold Spring Harbor Laboratory Press, Cold Spring Harbor, N.Y., 1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes animals in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. For a description of the cre/loxP recombinase system, see, e.g., Lakso et al. PNAS 89: 6232-6236 (1992). Another example of a recombinase system is the FLP recombinase system of S. cerevisiae (O'Gorman et al. Science 251: 1351-1355 (1991). If a cre/loxP recombinase system is used to regulate expression of the transgene, animals containing transgenes encoding both the Cre recombinase and a selected protein is required. Such animals can be provided through the construction of "double" transgenic animals, e.g., by mating two transgenic animals, one containing a transgene encoding a selected protein and the other containing a transgene encoding a recombinase.

Clones of the non-human transgenic animals described herein can also be produced according to the methods described in Wilmut, I. et al. Nature 385: 810-813 (1997) and PCT International Publication Nos. WO 97/07668 and WO 97/07669. In brief, a cell, e.g., a somatic cell, from the transgenic animal can be isolated and induced to exit the growth cycle and enter Go phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell, e.g., the somatic cell, is isolated.

Transgenic animals containing recombinant cells that express the peptides described herein are useful to conduct the assays described herein in an in vivo context. Accordingly, the various physiological factors that are present in vivo and that could effect substrate binding, PCAT protein activation, and signal transduction, may not be evident from in vitro cell-free or cell-based assays. Accordingly, it is useful to provide non-human transgenic animals to assay in vivo PCAT protein function, including substrate interaction, the effect of specific mutant PCAT proteins on PCAT protein function and substrate interaction, and the effect of chimeric PCAT proteins. It is also possible to assess the effect of null mutations, that is, mutations that substantially or completely eliminate one or more PCAT protein functions.

Detection and Diagnosis

The present invention provides a method for detecting PCAT nucleic acids, proteins, peptides and fragments thereof that are differentially expressed in pancreatic diseases in a test sample, preferably in a biological sample.

The present invention further provides a method for diagnosing the pancreatic diseases, by detecting the nucleic acids, proteins, peptides and fragments thereof. The further embodiment includes but is not limited to, monitoring the disease prognosis (recurrance), diagnosing disease stage, preventing the disease and treating the disease.

As used herein, a "biological sample" can be collected from tissues, blood, sera, cell lines or biological fluids such as, plasma, interstitial fluid, urine, cerebrospinal fluid, and the like, containing cells. In preferred embodiments, a biological sample comprises cells or tissues suspected of having diseases (e.g., cells obtained from a biopsy).

As used herein, a "differential level" is defined as the level of PCAT protein or nucleic acids in a test sample either above or below the level of the ones in control samples, wherein the level of control samples is obtained from a control cell line, a normal tissue or body fluids, or combination thereof, or from a healthy subject. While the protein is overexpressed, the expression of PCAT is preferably greater than about 20%, or preferably greater than about 30%, and most preferably greater than about 50% or more of pancreatic disease sample, at a level that is at least two fold, and preferably at least five fold, greater than the level of expression in control samples, as determined using a representative assay provided herein. While the protein is underexpressed, the expression of PCAT is preferably less than about 20%, or preferably less than 30%, and most preferably less than about 50% or more of the pancreatic disease sample, at a level that is at least 0.5 fold, and preferably at least 0.2 fold less than the level of the expression in control samples, as determined using a representative assay provided herein.

As used herein, a "subject" can be a mammalian subject or non mammalian subject, preferably, a mammalian subject. A mammalian subject can be human or non-human, preferably human. A healthy subject is defined as a subject without detectable pancreatic diseases or pancreatic associated diseases by using conventional diagnostic methods.

As used herein, the "diseases" include pancreatic diseases and pancreatic associated diseases. Preferably, the pancreatic disease is pancreatic cancer.

As used herein, "cancer" includes epithelial-cell related cancers, for example pancreatic, lung, colon, prostate, ovarian, breast, bladder renal, hepatocellular, pharyngeal and gastric cancers.

Nucleic Acid Detections

The present invention is not limited to the detection methods described above. Any suitable detection method that allows for the specific detection of pancreatic disease cells, tissues or organs may be utilized. For example, in some embodiments, the expression of RNA corresponding to a PCAT gene is detected by hybridization to an antisense oligonucleotide (described below). In other embodiments, RNA expression is detected by hybridization assays such as Northern blots, RNase assays, reverse transcriptase PCR amplification, and the like. One preferred detection method is using RT PCR by using TaqMan technology (ABI, Foster City, Calif.).

In another embodiment, the present invention provides a method for diagnosing or detecting pancreatic diseases in a subject comprising: determining the level of one or more PCAT nucleic acid molecules or any fragment(s) thereof in a test sample from said subject, wherein said PCAT nucleic acid molecule(s) comprises a sequence selected from a group consisting of SEQ ID NOS: 289-702 and a combination thereof; wherein a differential level of said PCAT nucleic acid molecule(s) relative to the level of said nucleic acid molecule(s) in a test sample from a healthy subject, or the level established for a healthy subject, is indicative of pancreatic diseases.

In another embodiment, the detecting or diagnosing method comprises determining level of differential expression of 2, 4, 8, 10, 20 or more nucleic acid molecules, preferably, the nucleic acid molecules comprise or consists of a sequence selected from the group consisting of SEQ ID NOS: 289-702 and combination thereof.

In further embodiments of the present invention, the presence of particular sequences in the genome of a subject is detected. Such sequences include PCAT sequences associated with abnormal expression of PCAT (e.g., overexpression or expression at a physiological inappropriate time). These sequences include polymorphisms, including polymorphisms in the transcribed sequence (e.g., that effect PCAT processing and/or translation) and regulatory sequences such as promoters, enhances, repressors, and the like. These sequences may also include polymorphisms in genes or control sequences associated with factors that affect expression such as transcription factors, and the like. Any suitable method for detecting and/or identifying these sequences is within the scope of the present invention including, but not limited to, nucleic acid sequencing, hybridization assays (e.g., Southern blotting), single nucleotide polymorphism assays (See e.g., U.S. Pat. No. 5,994,069, herein incorporated by reference in its entirety), and the like.

Protein Detections

The present invention provides methods for diagnosing or detecting the differential presence of PCAT proteins. In some embodiments (e.g., where PCATs are overexpressed in diseased cells), PCAT proteins are detected directly. In other embodiments (e.g., where the presence of a PCATs are underexpressed), PCATs to the disease antigens are detected non-existence.

The diagnostic methods of the present invention find utility in the diagnosis and characterization of diseases. For example, the presence of an antibody to a specific protein may be indicative of a cancer or disease. In addition, certain PCAT may be indicative of a specific stage or sub-type of the same cancer or disease.

The information obtained is also used to determine prognosis and appropriate course of treatment. For example, it is contemplated that individuals with a specific PCAT expression or stage of pancreatic diseases may respond differently to a given treatment that individuals lacking the PCAT expression. The information obtained from the diagnostic methods of the present invention thus provides for the personalization of diagnosis and treatment.

In one embodiment, the present invention provides a method for monitoring pancreatic diseases treatment in a subject comprising: determining the level of one or more PCAT proteins or any fragment(s) or peptide(s) thereof in a test sample from said subject, wherein said PCAT protein(s) comprises a sequence selected from a group consisting of SEQ ID NOS: 1-288, SEQ ID NOS: 703-873 and a combination thereof; wherein an level of said PCAT protein(s) similar to the level of said protein(s) in a test sample from a healthy subject, or the level established for a healthy subject, is indicative of successful treatment.

In another embodiment, the present invention provides a method for diagnosing recurrence of pancreatic diseases following successful treatment in a subject comprising: determining the level of one or more PCAT proteins or any fragment(s) or peptide(s) thereof in a test sample from said subject, wherein said PCAT protein(s) comprises a sequence selected from a group consisting of SEQ ID NOS: 1-288, SEQ ID NOS: 703-873 and a combination thereof; wherein a changed level of said PCAT protein(s) relative to the level of said protein(s) in a test sample from a healthy subject, or the level established for a healthy subject, is indicative of recurrence of pancreatic diseases.

In yet another embodiment, the present invention provides a method for diagnosing or detecting pancreatic diseases in a subject comprising: determining the level of one or more PCAT proteins or any fragment(s) or peptides thereof in a test sample from said subject, wherein said PCAT protein(s) comprises a sequence selected from a group consisting of SEQ ID NOS: 1-288, SEQ ID NOS: 703-873 and a combination thereof; wherein a differential level of said PCAT protein(s) relative to the level of said protein(s) in a test sample from a healthy subject, or the level established for a healthy subject, is indicative of pancreatic diseases.

The detecting or diagnosing method comprises determining level of differential expression of 2, 4, 8, 10, 20 or more proteins, preferably, the proteins are selected from a group consisting of SEQ ID NOS: 1-288 and combination thereof.

Further, the detecting or diagnosing method comprises determining level of differential expression of 5, 10, 15, 20, 40, 60, 80, 100 or more PCAT peptides, preferably the peptides are selected from the group consisting of SEQ ID NOS: 703-873 and combination thereof.

These methods are also useful for diagnosing diseases that show differential protein expression. As describe earlier, normal, control or standard values or level established from a healthy subject for protein expression are established by combining body fluids or tissue, cell extracts taken from a normal healthy mammalian or human subject with specific antibodies to a protein under conditions for complex formation. Standard values for complex formation in normal and diseased tissues are established by various methods, often photometric means. Then complex formation as it is expressed in a subject sample is compared with the standard values. Deviation from the normal standard and toward the diseased standard provides parameters for disease diagnosis or prognosis while deviation away from the diseased and toward the normal standard may be used to evaluate treatment efficacy.

In yet another embodiment, the present invention provides a detection or diagonistic method of PCATs by using LC/MS. The proteins from cells are prepared by methods known in the art (for example, R. Aebersold Nature Biotechnology Volume 21 Number 6 Jun. 2003). The differential expression of proteins in disease and healthy samples are quantitated using Mass Spectrometry and ICAT (Isotope Coded Affinity Tag) labeling, which is known in the art. ICAT is an isotope label technique that allows for discrimination between two populations of proteins, such as a healthy and a disease sample. The LC/MS spectra are collected for the labeled samples. The raw scans from the LC/MS instrument are subjected to peak detection and noise reduction software. Filtered peak lists are then used to detect 'features' corresponding to specific peptides from the original sample(s). Features are characterized by their mass/charge, charge, retention time, isotope pattern and intensity.

The intensity of a peptide present in both healthy and disease samples can be used to calculate the differential expression, or relative abundance, of the peptide. The intensity of a peptide found exclusively in one sample can be used to calculate a theoretical expression ratio for that peptide (singleton). Expression ratios are calculated for each peptide of each replicate of the experiment (Table 1). Thus overexpression or under expression of PCAT protein or peptide are similar to the expression pattern in Table 1 in a test subject indicates the likelihood of having pancreatic diseases or diseases associated with pancreas.

Immunological methods for detecting and measuring complex formation as a measure of protein expression using either specific polyclonal or monoclonal antibodies are known in the art. Examples of such techniques include enzyme-linked immunosorbent assays (ELISAs), radioimmunoassays (RIAs), fluorescence-activated cell sorting (FACS) and antibody arrays. Such immunoassays typically involve the measurement of complex formation between the protein and its specific antibody. These assays and their quantitation against purified, labeled standards are well known in the art (Ausubel, supra, unit 10.1-10.6). A two-site, monoclonal-based immunoassay utilizing antibodies reactive to two non-interfering epitopes is preferred, but a competitive binding assay may be employed (Pound (1998) Immunochemical Protocols, Humana Press, Totowa N.J.). More immunological detections are described in the sections below.

Antibody Detections

Antibodies are useful to detect the presence of one of the proteins or fragments thereof, peptides of the present invention in cells or tissues to determine the pattern of expression of the proteins among various tissues in an organism and over the course of normal development.

Further, as described above, the antibodies can be used to assess expression in disease states such as in active stages of the disease or in an individual with a predisposition toward disease related to the protein's function. The antibodies can also be used to assess normal and aberrant subcellular localization of cells in the various tissues in an organism.

Detection on a protein by an antibody can be facilitated by coupling (i.e., physically linking) the antibody to a detectable substance. Examples of detectable substances include various enzymes, prosthetic groups, fluorescent materials, luminescent materials, bioluminescent materials, and radioactive materials (see below). The antibodies may also be useful in diagnostic assays, e.g., for detecting expression of an antigen, for example PCAT protein, peptide or fragment thereof, in specific cells, tissues, blood, serum or body fluids.

For diagnostic applications, the antibody or its variant typically will be labeled with a detectable moiety. Numerous labels are available which can be generally grouped into the following categories:

(a) Radioisotopes, such as $^{36}$S, $^{14}$C, $^{125}$I, $^{3}$H, and $^{131}$I. The antibody variant can be labeled with the radioisotope using the techniques described in Current Protocols in Immunology, vol 1-2, Coligen et al., Ed., Wiley-Interscience, New York, Pubs. (1991) for example and radioactivity can be measured using scintillation counting.

(b) Fluorescent labels such as rare earth chelates (europium chelates) or fluorescein and its derivatives, rhodamine and its derivatives, dansyl, Lissamine, phycoerythrin and Texas Red are available. The fluorescent labels can be conjugated to the antibody variant using the techniques disclosed in Current Protocols in Immunology, supra, for example. Fluorescence can be quantified using a fluorimeter.

(c) Various enzyme-substrate labels are available and U.S. Pat. Nos. 4,275,149, and 4,318,980 provides a review of some of these. The enzyme generally catalyzes a chemical alteration of the chromogenic substrate which can be measured using various techniques. For example, the enzyme may catalyze a color change in a substrate, which can be measured spectrophotometrically. Alternatively, the enzyme may alter the fluorescence or chemiluminescence of the substrate. Techniques for quantifying a change in fluorescence are described above. The chemiluminescent substrate becomes electronically excited by a chemical reaction and may then emit light which can be measured (using a chemiluminometer, for example) or donates energy to a fluorescent acceptor. Examples of enzymatic labels include luciferases (e.g., firefly luciferase and bacterial luciferase; U.S. Pat. No. 4,737,456), luciferin, 2,3-dihydrophthalazinediones, malate dehydrogenase, urease, peroxidase such as horseradish peroxidase (HRPO), alkaline phosphatase, β-galactosidase, glucoamylase, lysozyme, saccharide oxidases (e.g., glucose oxidase, galactose oxidase, and glucose-6-phosphate dehydrogenase), heterocyclic oxidases (such as uricase and xanthine oxidase), lactoperoxidase, microperoxidase, and the like. Techniques for conjugating enzymes to antibodies are described in O'Sullivan et al., Methods for the Preparation of Enzyme-Antibody Conjugates for Use in Enzyme Immunoassay, in Methods in Enzyme. (Ed. J. Langone & H. Van Vunakis), Academic press, New York, 73: 147-166 (1981).

Sometimes, the label is indirectly conjugated with the antibody. The skilled artisan will be aware of various techniques for achieving this. For example, the antibody can be conjugated with biotin and any of the three broad categories of labels mentioned above can be conjugated with avidin, or vice versa. Biotin binds selectively to avidin and thus, the label can be conjugated with the antibody in this indirect manner. Alternatively, to achieve indirect conjugation of the label with the antibody, the antibody is conjugated with a small hapten (e.g. digloxin) and one of the different types of labels mentioned above is conjugated with an anti-hapten antibody (e.g. anti-digloxin antibody). Thus, indirect conjugation of the label with the antibody can be achieved.

In another embodiment of the invention, the antibody needs not be labeled, and the presence thereof can be detected using a labeled antibody, which binds to the antibody.

The antibodies of the present invention may be employed in any known assay method, such as competitive binding assays, direct and indirect sandwich assays, and immunoprecipitation assays. Zola, Monoclonal Antibodies: A Manual of Techniques, pp. 147-158 (CRC Press, Inc. 1987).

The biological samples can then be tested directly for the presence of PCAT by assays (e.g., ELISA or radioimmunoassay) and format (e.g., microwells, dipstick as described in International Patent Publication WO 93/03367). Alternatively, proteins in the sample can be size separated (e.g., by polyacrylamide gel electrophoresis (PAGE)), in the presence or absence of sodium dodecyl sulfate (SDS), and the presence of PCAT detected by immunoblotting (e.g., Western blotting). Immunoblotting techniques are generally more effective with antibodies generated against a peptide corresponding to an epitope of a protein, and hence, are particularly suited to the present invention.

Antibody binding is detected by techniques known in the art (e.g., radioimmunoassay, ELISA (enzyme-linked immunosorbant assay), "sandwich" immunoassays, immunoradiometric assays, gel diffusion precipitation reactions, immunodiffusion assays, in situ immunoassays (e.g., using colloidal gold, enzyme or radioisotope labels, for example), Western blots, precipitation reactions, agglutination assays (e.g., gel agglutination assays, hemagglutination assays, etc.), complement fixation assays, immunofluorescence assays, protein A assays, and immunoelectrophoresis assays, etc.

In one embodiment, antibody binding is detected by detecting a label on the primary antibody. In another embodiment, the primary antibody is detected by detecting binding of a secondary antibody or reagent to the primary antibody. In a further embodiment, the secondary antibody is labeled. Many means are known in the art for detecting binding in an immunoassay and are within the scope of the present invention. As is well known in the art, the immunogenic peptide should be provided free of the carrier molecule used in any immunization protocol. For example, if the peptide was conjugated to KLH, it may be conjugated to BSA, or used directly, in a screening assay. In some embodiments, an automated detection assay is utilized. Methods for the automation of immunoassays are well known in the art (See e.g., U.S. Pat. Nos. 5,885,530, 4,981,785, 6,159,750, and 5,358,691; each of which is herein incorporated by reference). In some embodiments, the analysis and presentation of results is also automated. For example, in some embodiments, software that generates a prognosis based on the presence or absence of a series of antigens is utilized.

Competitive binding assays rely on the ability of a labeled standard to compete with the test sample for binding with a limited amount of antibody. The amount of antigen in the test sample is inversely proportional to the amount of standard that becomes bound to the antibodies. To facilitate determining the amount of standard that becomes bound, the antibodies generally are insolubilized before or after the competition. As a result, the standard and test sample that are bound to the antibodies may conveniently be separated from the standard and test sample, which remain unbound.

Sandwich assays involve the use of two antibodies, each capable of binding to a different immunogenic portion, or epitope, or the protein to be detected. In a sandwich assay, the test sample to be analyzed is bound by a first antibody, which is immobilized on a solid support, and thereafter a second antibody binds to the test sample, thus forming an insoluble three-part complex. See e.g., U.S. Pat. No. 4,376,110. The second antibody may itself be labeled with a detectable moiety (direct sandwich assays) or may be measured using an anti-immunoglobulin antibody that is labeled with a detectable moiety (indirect sandwich assay). For example, one type of sandwich assay is an ELISA assay, in which case the detectable moiety is an enzyme.

The antibodies may also be used for in vivo diagnostic assays. Generally, the antibody is labeled with a radionucleotide (such as $^{111}$In, $^{99}$Tc, $^{14}$C, $^{131}$I, $^{3}$H, $^{32}$P or $^{35}$S) so that the tumor can be localized using immunoscintiography. In one embodiment, antibodies or fragments thereof bind to the extracellular domains of two or more PCAT targets and the affinity value(Kd) is less than $1\times10^8$ M.

Antibodies for diagnostic use may be labeled with probes suitable for detection by various imaging methods. Methods for detection of probes include, but are not limited to, fluorescence, light, confocal and electron microscopy; magnetic resonance imaging and spectroscopy; fluoroscopy, computed tomography and positron emission tomography. Suitable probes include, but are not limited to, fluorescein, rhodamine, eosin and other fluorophores, radioisotopes, gold, gadolinium and other lanthanides, paramagnetic iron, fluorine-18 and other positron-emitting radionuclides. Additionally, probes may be bi- or multi-functional and be detectable by more than one of the methods listed. These antibodies may be directly or indirectly labeled with said probes. Attachment of probes to the antibodies includes covalent attachment of the probe, incorporation of the probe into the antibody, and the covalent attachment of a chelating compound for binding of probe, amongst others well recognized in the art.

For immunohistochemistry, the disease tissue sample may be fresh or frozen or may be embedded in paraffin and fixed with a preservative such as formalin (see Examples). The fixed or embedded section contains the sample are contacted with a labeled primary antibody and secondary antibody, wherein the antibody is used to detect the PCAT protein express in situ. The detailed procedure is shown in the Example.

Array:

"Array" refers to an ordered arrangement of at least two transcripts, proteins or peptides, or antibodies on a substrate. At least one of the transcripts, proteins, or antibodies represents a control or standard, and the other transcript, protein, or antibody is of diagnostic or therapeutic interest. The arrangement of at least two and up to about 40,000 transcripts, proteins, or antibodies on the substrate assures that the size and signal intensity of each labeled complex, formed between each transcript and at least one nucleic acid, each protein and at least one ligand or antibody, or each antibody and at least one protein to which the antibody specifically binds, is individually distinguishable.

An "expression profile" is a representation of gene expression in a sample. A nucleic acid expression profile is produced using sequencing, hybridization, or amplification technologies using transcripts from a sample. A protein expression profile, although time delayed, mirrors the nucleic acid expression profile and is produced using gel electrophoresis, mass spectrometry, or an array and labeling moieties or antibodies which specifically bind the protein. The nucleic acids, proteins, or antibodies specifically binding the protein may be used in solution or attached to a substrate, and their detection is based on methods well known in the art.

A substrate includes but not limits to, paper, nylon or other type of membrane, filter, chip, glass slide, or any other suitable solid support. The invention also provides an array with a cDNA or transcript encoding PCAT proteins or peptides or fragments thereof, antibodies that specifically bind PCAT proteins, peptides or fragments thereof. Preferably, two or more of the nucleic acid molecules (e.g., SEQ ID NOS: 289-702), proteins (e.g., SEQ ID NOS: 1-288) or peptides (e.g., SEQ ID NOS: 703-873) are immobilized on a substrate. Specifically, the following targets are selected for targeting purpose:Tissue Factor, GS3786, Na/K ATPase Beta-3, Kunitz Type inhibitor-2 (HAI-2), CD46, CD166, Neutral Amino Acid Transporter (ASCT2), Transglutaminase-2 (TGM2), Kunitz Inhibitor-1, ErbB3, Mucin 4, Decay Accelerating Factor (DAF).

The present invention also provides an antibody array. Antibody arrays have allowed the development of techniques for high-throughput screening of recombinant antibodies. Such methods use robots to pick and grid bacteria containing antibody genes, and a filter-based ELISA to screen and identify clones that express antibody fragments. Because liquid handling is eliminated and the clones are arrayed from master stocks, the same antibodies can be spotted multiple times and screened against multiple antigens simultaneously. For more information, see de Wildt et al. (2000) Nat Biotechnol 18: 989-94.

The array is prepared and used according to the methods described in U.S. Pat. No. 5,837,832, Chee et al., PCT application WO95/11995 (Chee et al.), Lockhart, D. J. et al. (1996; Nat. Biotech. 14: 1675-1680) and Schena, M. et al. (1996; Proc. Natl. Acad. Sci. 93: 10614-10619), U.S. Pat. No. 5,807, 522, Brown et al., all of which are incorporated herein in their entirety by reference.

In one embodiment, a nucleic acid array or a microarray, preferably composed of a large number of unique, single-stranded nucleic acid sequences, usually either synthetic antisense oligonucleotides or fragments of cDNAs, fixed to a solid support. The oligonucleotides are preferably about 6-60 nucleotides in length, more preferably 15-30 nucleotides in length, and most preferably about 20-25 nucleotides in length.

In order to produce oligonucleotides to a known sequence for an array, the gene(s) of interest (or an ORF identified from the contigs of the present invention) is typically examined using a computer algorithm which starts at the 5' or at the 3' end of the nucleotide sequence. Typical algorithms will then identify oligomers of defined length that are unique to the gene, have a GC content within a range suitable for hybridization, and lack predicted secondary structure that may interfere with hybridization. In certain situations it may be appropriate to use pairs of oligonucleotides on an array. The "pairs" will be identical, except for one nucleotide that preferably is located in the center of the sequence. The second oligonucleotide in the pair (mismatched by one) serves as a control. The number of oligonucleotide pairs may range from two to one million. The oligomers are synthesized at designated areas on a substrate using a light-directed chemical process, wherein the substrate may be paper, nylon or other type of membrane, filter, chip, glass slide or any other suitable solid support as described above.

In another aspect, an oligonucleotide may be synthesized on the surface of the substrate by using a chemical coupling procedure and an ink jet application apparatus, as described in PCT application WO95/251116 (Baldeschweiler et al.) which is incorporated herein in its entirety by reference.

A gene expression profile comprises the expression of a plurality of transcripts as measured by hybridization with a sample. The transcripts of the invention may be used as elements on an array to produce a gene expression profile. In one embodiment, the array is used to diagnose or monitor the progression of disease. Researchers can assess and catalog the differences in gene expression between healthy and diseased tissues or cells.

For example, the transcript or probe may be labeled by standard methods and added to a biological sample from a patient under conditions for the formation of hybridization complexes. After an incubation period, the sample is washed and the amount of label (or signal) associated with hybridization complexes, is quantified and compared with a standard value. If complex formation in the patient sample is significantly altered (higher or lower) in comparison to either a normal or disease standard, then differential expression indicates the presence of a disorder.

In order to provide standards for establishing differential expression, normal and disease expression profiles are established. This is accomplished by combining a sample taken from normal subjects, either animal or human or nonmammal, with a transcript under conditions for hybridization to occur. Standard hybridization complexes may be quantified by comparing the values obtained using normal subjects with values from an experiment in which a known amount of a purified sequence is used. Standard values obtained in this manner may be compared with values obtained from samples from patients who were diagnosed with a particular condition, disease, or disorder. Deviation from standard values toward those associated with a particular disorder is used to diagnose that disorder.

By analyzing changes in patterns of gene/protein expression, disease can be diagnosed at earlier stages before the patient is symptomatic. The invention can be used to formulate a prognosis and to design a treatment regimen. The invention can also be used to monitor the efficacy of treatment. For treatments with known side effects, the array is employed to improve the treatment regimen. A dosage is established that causes a change in genetic expression patterns indicative of successful treatment. Expression patterns associated with the onset of undesirable side effects are avoided.

In another embodiment, animal models which mimic a human disease can be used to characterize expression profiles associated with a particular condition, disease, or disorder; or treatment of the condition, disease, or disorder. Novel treatment regimens may be tested in these animal models using arrays to establish and then follow expression profiles over time. In addition, arrays may be used with cell cultures or tissues removed from animal models to rapidly screen large numbers of candidate drug molecules, looking for ones that produce an expression profile similar to those of known therapeutic drugs, with the expectation that molecules with the same expression profile will likely have similar therapeutic effects. Thus, the invention provides the means to rapidly determine the molecular mode of action of a drug.

Such assays may also be used to evaluate the efficacy of a particular therapeutic treatment regimen in animal studies or in clinical trials or to monitor the treatment of an individual patient. Once the presence of a condition is established and a treatment protocol is initiated, diagnostic assays may be repeated on a regular basis to determine if the level of expression in the patient begins to approximate that, which is observed in a normal subject. The results obtained from successive assays may be used to show the efficacy of treatment over a period ranging from several days to years.

In one embodiment, the detected targets comprise, consist essentially of or consist of combinations of PCAT proteins or nucleic acids encoding such proteins. The combinations are either 2, 3, 4, 5, 6, 7, 8, 9, 10, 15, 20, 25, 30, 35, 40, 50, 60, 70, 80, 90, 100, 150, 200, 250 proteins (SEQ ID NOS: 1-288), nucleic acids (SEQ ID NOS: 289-702) encoding such proteins, or peptides (SEQ ID NOS: 703-873).

In one embodiment, the combinations of the protein or nucleic acid targets for detection of a pancreatic cancer comprise targets selected from a group consisting of Tissue Factor, GS3786, Na/K ATPase Beta-3, Kunitz Type inhibitor-1 (HAI-1), Kunitz Type inhibitor-2 (HAI-2), CD46, CD166, Neutral Amino Acid Transporter (ASCT2), Transglutaminase-2 (TGM2), Kunitz Inhibitor-1, ErbB3, Mucin 4, Decay Accelerating Factor (DAF), wherein their corresponding sequences are listed in Table 2.

In another embodiment, the detection targets are combination of all the targets of Tissue Factor, GS3786, Na/K ATPase Beta-3, Kunitz Type inhibitor-1 (HAI-1), Kunitz Type inhibitor-2 (HAI-2), CD46, CD166, Neutral Amino Acid Transporter (ASCT2), Transglutaminase-2 (TGM2), Kunitz Inhibitor-1, ErbB3, Mucin 4, Decay Accelerating Factor (DAF).

In yet another embodiment, the invention provides a composition comprising a plurality of PCAT nucleic acid sequences for use in detecting the differential expression of genes in a disease state, wherein said plurality of nucleic acid sequences comprise two or more sequences of SEQ ID NOS: 289-702, or all the sequences of SEQ ID NOS: 289-702, or the complete complements thereof. Further, the nucleic acid sequences are immobilized on a substrate, and the said nucleic acid sequences are hybridizable elements on a microarray.

In yet another embodiment, the invention provides a composition comprising a plurality of PCAT proteins or peptides for use in detecting the differential expression of proteins in a disease state wherein said plurality of protein sequences comprise two or more sequences of SEQ ID NOS: 1-288 or all sequence of SEQ ID NOS: 1-288; and wherein said plurality of peptide sequences comprise two or more sequences of SEQ ID NOS: 703-873 or all sequence of SEQ ID NOS: 703-873.

In yet another embodiment, the compositions can be used in diagnosing or monitoring the treatment of pancreatic cancer Treatment The following terms, as used in the present specification and claims, are intended to have the meaning as defined below, unless indicated otherwise.

"Treat," "treating" or "treatment" of a disease includes:

(1) inhibiting the disease, i.e., arresting or reducing the development of the disease or its clinical symptoms, or (2) relieving the disease, i.e., causing regression of the disease or its clinical symptoms.

A "therapeutically effective amount" means the amount of an agent that, when administered to a subject for treating a disease, is sufficient to effect such treatment for the disease. The "therapeutically effective amount" will vary depending on the agent, the disease and its severity and the age, weight, etc., of the subject to be treated.

A "pancreatic disease" includes pancreatic cancer, pancreatic tumor (exocrine or endocrine), pancreatic cysts, acute pancreatitis, chronic pancreatitis, diabetes (type I and II) as well as pancreatic trauma, preferably pancreatic cancer.

A "cancer" is epithelial-cell related cancers include but not limited to pancreatic, lung, colon, prostate, ovarian, breast, bladder renal, hepatocellular, pharyngeal and gastric cancers.

The present invention provides an application of treatment by using antibody, immunogenic peptides as well as other PCAT agonists or antagonists.

PCATs are proteins differentially expressed in the pancreatic diseases cell lines or tissues. The proteins are either cell surface proteins or cytosolic proteins (see the list in Table 2). These proteins are associated with the diseases especially pancreatic diseases, particularly pancreatic cancer; thus, they serve as candidate targets for the treatment of the diseases.

In one embodiment, when decreased expression or activity of the protein is desired, an inhibitor, antagonist, antibody and the like or a pharmaceutical agent containing one or more of these molecules may be delivered. Such delivery may be effected by methods well known in the art and may include delivery by an antibody specifically targeted to the protein. Neutralizing antibodies, which inhibit dimer formation, are generally preferred for therapeutic use.

In another embodiment, when increased expression or activity of the protein is desired, the protein, an agonist, an enhancer and the like or a pharmaceutical agent containing one or more of these molecules may be delivered. Such delivery may be effected by methods well known in the art and may include delivery of a pharmaceutical agent by an antibody specifically targeted to the protein.

Any of the transcripts, complementary molecules, or fragments thereof, proteins or portions thereof, vectors delivering these nucleic acid molecules or expressing the proteins, and their ligands may be administered in combination with other therapeutic agents. Selection of the agents for use in combination therapy may be made by one of ordinary skill in the art according to conventional pharmaceutical principles. A combination of therapeutic agents may act synergistically to affect treatment of a particular disorder at a lower dosage of each agent.

Antibody Therapy

The antibody of the present invention can be used for therapeutic reasons. It is contemplated that the antibody of the present invention may be used to treat a mammal, preferably a human with pancreatic diseases.

In general, the antibodies are also useful for inhibiting protein function, for example, blocking the binding of the PCAT protein or peptide to a binding partner such as a substrate. These uses can also be applied in a therapeutic context in which treatment involves inhibiting the protein's function. An antibody can be used, for example, to block binding, thus modulating (agonizing or antagonizing) the peptides activity. Antibodies can be prepared against specific fragments containing sites required for function or against intact protein that is associated within a cell or cell membrane. The function blocking assays are provided in detail in the Examples. Other evidence is provided in U.S. Pat. No. 6,207,152, and U.S. Patnet No. 6,387,371.

The antibodies of present invention can also be used as means of enhancing the immune response. The antibodies can be administered in amounts similar to those used for other therapeutic administrations of antibody. For example, pooled gamma globulin is administered at a range of about 1 mg to about 100 mg per patient. Thus, antibodies reactive with the protein or peptides of PCAT can be passively administered alone or in conjunction with other anti-cancer therapies to a mammal afflicted-with pancreatic diseases or cancer. Examples of anti-cancer therapies include, but are not limited to, chemotherapy, radiation therapy, adoptive immunotherapy therapy with TIL (Tumor Infiltration Lymphocytes).

The selection of an antibody subclass for therapy will depend upon the nature of the disease tumor antigen. For example, an IgM may be preferred in situations where the antigen is highly specific for the diseased target and rarely occurs on normal cells. However, where the disease-associated antigen is also expressed in normal tissues, although at much lower levels, the IgG subclass may be preferred for the following reason: since the binding of at least two IgG molecules in close proximity is required to activate complement, less complement mediated damage may occur in the normal tissues which express smaller amounts of the antigen and, therefore, bind fewer IgG antibody molecules. Furthermore, IgG molecules by being smaller may be more able than IgM molecules to localize to the diseased tissue.

The mechanism for antibody therapy is that the therapeutic antibody recognizes a cell surface protein or a cytosolic protein that is overexpressed in diseased cells. By NK cell or complement activation, conjugation of the antibody with an immunotoxin or radiolabel, the interaction can abrogate ligand/receptor interaction or activation of apoptosis.

The potential mechanisms of antibody-mediated cytotoxicity of diseased cells are phagocyte (antibody dependent cellular cytotoxicity (ADCC)) (see Example), complement (Complement-mediated cytotoxicity (CMC)) (see Example), naked antibody (receptor cross-linking apoptosis and growth factor inhibition), or targeted payload labeled with radionuclide or immunotoxins or immunochemotherapeutics.

In one embodiment, the antibody is administered to a non-human mammal for the purposes of obtaining preclinical data, for example. Exemplary nonhuman mammals to be treated include nonhuman primates, dogs, cats, rodents and other mammals in which preclinical studies are performed. Such mammals may be established animal models for a disease to be treated with the antibody or may be used to study toxicity of the antibody of interest. In each of these embodiments, dose escalation studies may be performed on the mammal.

The antibody is administered by any suitable means, including parenteral, subcutaneous, intraperitoneal, intrapulmonary, and intranasal, and, if desired for local immunosuppressive treatment, intralesional administration. Parenteral infusions include intramuscular, intravenous, intraarterial, intraperitoneal, or subcutaneous administration. In addition, the antibody variant is suitably administered by pulse infusion, particularly with declining doses of the antibody variant. Preferably the dosing is given by injections, most preferably intravenous or subcutaneous injections, depending in part on whether the administration is brief or chronic.

For the prevention or treatment of a disease, the appropriate dosage of the antibody will depend on the type of disease to be treated, the severity and the course of the disease, whether the antibody is administered for preventive or therapeutic purposes, previous therapy, the patient's clinical history and response to the antibody, and the discretion of the attending physician.

Depending on the type and severity of the disease, about 1 .mu.g/kg to 150 mg/kg (e.g., 0.1-20 mg/kg) of antibody is an initial candidate dosage for administration to the patient, whether, for example, by one or more separate administrations, or by continuous infusion. A typical daily dosage might range from about 1 .mu.g/kg to 100 mg/kg or more, depending on the factors mentioned above. For repeated administrations over several days or longer, depending on the condition, the treatment is sustained until a desired suppression of disease symptoms occurs. However, other dosage regimens may be useful. The progress of this therapy is easily monitored by conventional techniques and assays.

The antibody composition will be formulated, dosed and administered in a manner consistent with good medical practice. Factors for consideration in this context include the particular disorder being treated, the particular mammal being treated, the clinical condition of the individual patient, the cause of the disorder, the site of delivery of the agent, the method of administration, the scheduling of administration, and other factors known to medical practitioners.

The therapeutically effective amount of the antibody to be administered will be governed by such considerations, and is the minimum amount necessary to prevent, ameliorate, or treat a disease or disorder. The antibody need not be, but is optionally formulated with one or more agents currently used to prevent or treat the disorder in question.

Antibodies of the present invention may also be used as therapeutic reagents, to diminish or eliminate cancer or tumors. For example, the antibodies may be used on their own (for instance, to inhibit metastases) or coupled to one or more therapeutic agents. Suitable agents in this regard include radionuclides, differentiation inducers, drugs, toxins, and derivatives thereof. Preferred radionuclides include $^{90}$Y, $^{123}$I, $^{125}$I, $^{131}$I, $^{186}$Re, $^{188}$Re, $^{211}$At, and .$^{212}$Bi. Preferred drugs include methotrexate, and pyrimidine and purine analogs. Preferred differentiation inducers include phorbol esters and butyric acid. Preferred toxins include ricin, abrin, diptheria toxin, cholera toxin, gelonin, *Pseudomonas exotoxin*, *Shigella* toxin, and pokeweed antiviral protein A therapeutic agent may be coupled (e.g., covalently bonded) to a suitable monoclonal antibody either directly or indirectly (e.g., via a linker group). A direct reaction between an agent and an antibody is possible when each possesses a substituent capable of reacting with the other. For example, a nucleophilic group, such as an amino or sulfhydryl group, on one may be capable of reacting with a carbonyl-containing group, such as an anhydride or an acid halide, or with an alkyl group containing a good leaving group (e.g., a halide) on the other.

Alternatively, it may be desirable to couple a therapeutic agent and an antibody via a linker group. A linker group can function as a spacer to distance an antibody from an agent in order to avoid interference with binding capabilities. A linker group can also serve to increase the chemical reactivity of a substituent on an agent or an antibody, and thus increase the coupling efficiency. An increase in chemical reactivity may also facilitate the use of agents, or functional groups on agents, which otherwise would not be possible.

It will be evident to those skilled in the art that a variety of bifunctional or polyfunctional reagents, both homo- and hetero-functional (such as those described in the catalog of the Pierce Chemical Co., Rockford, Ill.), may be employed as the linker group. Coupling may be affected, for example, through amino groups, carboxyl groups, sulfhydryl groups or oxidized carbohydrate residues. There are numerous references describing such methodology, e.g. U.S. Pat. No. 4,671,958, to Rodwell et al.

Where a therapeutic agent is more potent when free from the antibody portion of the immunoconjugates of the present invention, it may be desirable to use a linker group which is cleavable during or upon internalization into a cell. A number of different cleavable linker groups have been described. The mechanisms for the intracellular release of an agent from these linker groups include cleavage by reduction of a disulfide bond (e.g., U.S. Pat. No. 4,489,710, to Spitler), by irradiation of a photolabile bond (e.g., U.S. Pat. No. 4,625,014, to Senter et al.), by hydrolysis of derivatized amino acid side chains (e.g., U.S. Pat. No. 4,638,045, to Kohn et al.), by serum complement-mediated hydrolysis (e.g., U.S. Pat. No. 4,671,958, to Rodwell et al.), and acid-catalyzed hydrolysis (e.g., U.S. Pat. No. 4,569,789, to Blattler et al.).

It may be desirable to couple more than one agent to an antibody. In one embodiment, multiple molecules of an agent are coupled to one antibody molecule. In another embodiment, more than one type of agent may be coupled to one antibody. Regardless of the particular embodiment, immunoconjugates with more than one agent may be prepared in a variety of ways as described above.

While it is possible for the immunogen to be administered in a pure or substantially pure form, it is preferable to present it as a pharmaceutical composition, formulation or preparation with a carrier.

The formulations of the present invention, both for veterinary and for human use, comprise an immunogen as described above, together with one or more pharmaceutically acceptable carriers and, optionally, other therapeutic ingredients. The carrier(s) must be "acceptable" in the sense of being compatible with the other ingredients of the formulation and not deleterious to the recipient thereof. The formulations may conveniently be presented in unit dosage form and may be prepared by any method well-known in the pharmaceutical art.

Suitable pharmaceutical carriers include proteins such as albumins (e.g., U.S. Pat. No. 4,507,234, to Kato et al.), peptides and polysaccharides such as aminodextran (e.g., U.S. Pat. No. 4,699,784 to Shih et al.); or water. A carrier may also bear an agent by noncovalent bonding or by encapsulation, such as within a liposome vesicle (e.g., U.S. Pat. Nos. 4,429,008 and 4,873,088). Carriers specific for radionuclide agents include radiohalogenated small molecules and chelating compounds. For example, U.S. Pat. No. 4,735,792 discloses representative radiohalogenated small molecules and their synthesis. A radionuclide chelate may be formed from chelating compounds that include those containing nitrogen and sulfur atoms as the donor atoms for binding the metal, metal oxide, radionuclide. For example, U.S. Pat. No. 4,673,562, to Davison et al. discloses representative chelating compounds and their synthesis.

All methods include the step of bringing into association the active ingredient with the carrier, which constitutes one or more accessory ingredients. In general, the formulations are prepared by uniformly and intimately bringing into association the active ingredient with liquid carriers or finely divided solid carriers or both, and then, if necessary, shaping the product into the desired formulation.

Formulations suitable for intravenous intramuscular, subcutaneous, or intraperitoneal administration conveniently comprise sterile aqueous solutions of the active ingredient with solutions, which are preferably isotonic with the blood of the recipient. Such formulations may be conveniently prepared by dissolving solid active ingredient in water containing physiologically compatible substances such as sodium chloride (e.g. 0.1-2.0M), glycine, and the like, and having a buffered pH compatible with physiological conditions to produce an aqueous solution, and rendering said solution sterile. These may be present in unit or multi-dose containers, for example, sealed ampoules or vials.

The formulations of the present invention may incorporate a stabilizer. Illustrative stabilizers are polyethylene glycol, proteins, saccharides, amino acids, inorganic acids, and organic acids, which may be used either on their own or as admixtures. These stabilizers are preferably incorporated in an amount of 0.11-10,000 parts by weight per part by weight of immunogen. If two or more stabilizers are to be used, their total amount is preferably within the range specified above. These stabilizers are used in aqueous solutions at the appropriate concentration and pH. The specific osmotic pressure of such aqueous solutions is generally in the range of 0.1-3.0 osmoles, preferably in the range of 0.8-1.2. The pH of the aqueous solution is adjusted to be within the range of 5.0-9.0, preferably within the range of 6-8. In formulating the antibody of the present invention, anti-adsorption agent may be used.

Additional pharmaceutical methods may be employed to control the duration of action. Controlled release preparations may be achieved through the use of polymer to complex or absorb the proteins or their derivatives. The controlled delivery may be exercised by selecting appropriate macromolecules (for example polyester, polyamino acids, polyvinyl, pyrrolidone, ethylenevinylacetate, methylcellulose, carboxymethylcellulose, or protamine sulfate) and the concentration of macromolecules as well as the methods of incorporation in order to control release. Another possible method to control the duration of action by controlled-release preparations is to incorporate the PCAT antibody into particles of a polymeric material such as polyesters, polyamino acids, hydrogels, poly(lactic acid) or ethylene vinylacetate copolymers. Alternatively, instead of incorporating these agents into polymeric particles, it is possible to entrap these materials in microcapsules prepared, for example, by coacervation techniques or by interfacial polymerization, for example, hydroxymethylcellulose or gelatin-microcapsules and poly (methylmethacylate) microcapsules, respectively, or in colloidal drug delivery systems, for example, liposomes, albumin microspheres, microemulsions, nanoparticles, and nanocapsules or in macroemulsions.

When oral preparations are desired, the compositions may be combined with typical carriers, such as lactose, sucrose, starch, talc magnesium stearate, crystalline cellulose, methyl cellulose, carboxymethyl cellulose, glycerin, sodium alginate or gum arabic among others.

The therapeutic antibody may be supplied in the form of a kit, alone, or in the form of a pharmaceutical composition as described above.

Other Immunotherapy

The PCAT proteins, peptides, or fragments thereof of this invention are also intended for use in producing antiserum designed for pre- or post-disease prophylaxis. Here the protein, peptides or fragment thereof, is formulated with a suitable adjuvant and administered by injection to human volunteers, according to known methods for producing human antisera. Antibody response to the injected proteins is monitored, during a several-week period following immunization, by periodic serum sampling to detect the presence of antiserum antibodies, using an immunoassay as described herein.

The antiserum from immunized individuals may be administered as a prophylactic measure for individuals who are at risk of developing pancreatic diseases or cancer. The antiserum is also useful in treating an individual afflicted with pancreatic diseases or cancer for post-disease prophylaxis.

Alternatively, peptides derived form the PCAT protein sequence may be modified to increase their immunogenicity by enhancing binding of the peptide to the MHC molecules in which the peptide is presented. The peptide or modified peptide may be conjugated to a carrier molecule to enhance the antigenicity of the peptide. Examples of carrier molecules, include, but are not limited to, human albumin, bovine albumin, lipoprotein and keyhole limpet hemo-cyanin ("Basic and Clinical immunology" (1991) Stites, D. P. and Terr A. I. (eds) Appleton and Lange, Norwalk Conn., San Mateo, Calif.).

An "immunogenic peptide" is a peptide, which comprises an allele-specific motif such that the peptide will bind the MHC allele (HLA in human) and be capable of inducing a CTL (cytoxic T-lymphocytes) response. Thus, immunogenic peptides are capable of binding to an appropriate class I or II MHC molecule and inducing a cytotoxic T cell or T helper cell response against the antigen from which the immunogenic peptide is derived.

Alternatively, amino acid sequence variants of the peptide can be prepared by mutations in the DNA, which encodes the peptide, or by peptide synthesis.

At the genetic level, these variants ordinarily are prepared by site-directed mutagenesis of nucleotides in the DNA encoding the peptide molecule, thereby producing DNA encoding the variant, and thereafter expressing the DNA in recombinant cell culture. The variants typically exhibit the same qualitative biological activity as the nonvariant peptide.

T-lymphocytes recognize antigen in association with Class I or Class II MHC molecules in the form of a peptide fragment bound to an MHC molecule. The degree of peptide binding to a given MHC allele is based on amino acids at particular positions within the peptide-(Parker et al. (1992) Journal of Immunology 149: 3580; Kubo, et al. (1994) Journal of Immunology 52: 3913-3924; Ruppert J. et al. (1993) Cell 74: 929-937; Falk et al. (1991) Nature 351: 290-296). The peptides of the present invention are useful as an epitope for immunogenic response (see more detailed description below).

In human, MHC is called HLA, wherein class I molecules are encoded by the HLA-A, B, and C loci. HLA-A and B antigens are expressed at the cell surface at approximately equal densities, whereas the expression of HLA-C is significantly lower (about 10-fold lower). Each of these loci has a number of alleles. MHC class II molecules are encoded by three pairs of MHC II alpha- and beta-chain genes, called HLA DR, -DP, and -DQ in human. In many haplotypes the HLA-DR cluster contains an extra beta-chain gene whose product can pair with the DR alpha chain. Each MHC class I and II molecule binds a different rage of peptides. The present of several loci means that any one individual is equipped to present a much broader ranger of different peptides than if only one MHC protein of each class were expressed at the cell surface. The peptide binding motifs of the present invention are designed to be specific for each allelic subtype.

The peptides of the present invention are used for treatment of the pancreatic diseases. Treatment involves administration of the protective composition after the appearance of the disease.

The present invention is also applied to prevent and suppress the disease. It is not always possible to distinguish between "preventing" and "suppressing" since the ultimate inductive event or events may be unknown, latent, or the patient is not ascertained until well after the occurrence of the event or events. Therefore, it is common to use the term "prophylaxis" as distinct from "treatment" to encompass both "preventing" and "suppressing" as defined herein. The term "protection," as used herein, is meant to include "prophylaxis."

The peptides are used for treating T cell-mediated pathology. The term "T cell-mediated pathology" refers to any condition in which an inappropriate T cell response is a component of the pathology. The term is intended to encompass both T cell mediated pancreatic diseases and diseases resulting from unregulated clonal T cell replication.

Therefore, the present invention relates to peptides or modified peptides derived from the protein sequences of the PCAT proteins that differentially expressed in the pancreatic diseases. By way of example, modification may include substitution, deletion or addition of an amino acid in the given immunogenic peptide sequence or mutation of existing amino acids within the given immunogenic peptide sequence, or derivatization of existing amino acids within the given immunogenic peptide sequence. Any amino acid comprising the immunogenic peptide sequence may be modified in accordance with this invention. In one aspect, at least one amino acid is substituted or replaced within the given immunogenic peptide sequence. Any amino acid may be used to substitute or replace a given amino acid within the immunogenic peptide sequence. Modified peptides are intended to include any immunogenic peptide obtained from differentially expressed proteins, which has been modified and exhibits enhanced binding to the MHC molecule with which it associates when presented to the T-cell. These modified peptides may be synthetically or recombinantly produced by conventional methods.

In another embodiment, the peptides of the present invention comprise, or consisting sequences of about 5-8, 8-10, 10-15 or 15-30 amino acids which are immunogenic, that is, capable of inducing an immune response when injected into a subject.

The recombinant or natural protein, peptides, or fragment thereof of PCAT, or modified peptides, may be used as a vaccine either prophylactically or therapeutically. When provided prophylactically the vaccine is provided in advance of any evidence of pancreatic diseases, particularly, cancer. The prophylactic administration of the pancreatic disease vaccine should serve to prevent or attenuate pancreatic diseases, preferably cancer, in a mammal.

Preparation of vaccine is using recombinant protein or peptide expression vectors comprising all or part of nucleic acid sequence of PCAT proteins encoding peptides. Examples of vectors that may be used in the aforementioned vaccines include, but are not limited to, defective retroviral vectors, adenoviral vectors vaccinia viral vectors, fowl pox viral vectors, or other viral vectors (Mulligan, R. C., (1993) Science 260: 926-932). The viral vectors carrying all or part of nucleic sequence of SEQ ID NOS: 289-702 can be introduced into a mammal either prior to any evidence of pancreatic diseases or to mediate regression of the disease in a mammal afflicted with pancreatic diseases. Examples of methods for administering the viral vector into the mammals include, but are not limited to, exposure of cells to the virus ex vivo, or injection of the retrovirus or a producer cell line of the virus into the affected tissue or intravenous administration of the virus. Alternatively the viral vector carrying all or part of the PCAT nucleic acid sequence that encode peptides may be administered locally by direct injection into the cancer lesion or topical application in a pharmaceutically acceptable carrier. The quantity of viral vector, carrying all or part of the PCAT nucleic acid sequence, to be administered is based on the titer of virus particles. A preferred range of the immunogen to be administered may be about 106 to about 1011 virus particles per mammal, preferably a human. After immunization the efficacy of the vaccine can be assessed by production of antibodies or immune cells that recognize the antigen, as assessed by specific lytic activity or specific cytokine production or by tumor regression. One skilled in the art would know the conventional methods to assess the aforementioned parameters. If the mammal to be immunized is already afflicted with cancer, the vaccine can be administered in conjunction with other therapeutic treatments. Examples of other therapeutic treatments includes, but are not limited to, adoptive T cell immunotherapy, coadministration of cytokines or other therapeutic drugs for cancer.

Alternatively all or parts thereof of a substantially or partially purified the PCAT proteins or their peptides may be administered as a vaccine in a pharmaceutically acceptable carrier. Ranges of the protein that may be administered are about 0.001 to about 100 mg per patient, preferred doses are about 0.01 to about 100 mg per patient. In a preferred embodiment, the peptides or modified peptides thereof is administered therapeutically or prophylactically to a mammal in need of such treatment. The peptide may be synthetically or recombinantly produced. Immunization is repeated as necessary, until a sufficient titer of anti-immunogen antibody or immune cells has been obtained.

In yet another alternative embodiment a viral vector, such as a retroviral vector, can be introduced into mammalian cells. Examples of mammalian cells into which the retroviral vector can be introduced include, but are not limited to, primary mammalian cultures or continuous mammalian cultures, COS cells, NIH3T3, or 293 cells (ATTC #CRL 1573), dendritic cells. The means by which the vector carrying the gene may be introduced into a cell includes, but is not limited to, microinjection, electroporation, transfection or transfection using DEAE dextran, lipofection, calcium phosphate or other procedures known to one skilled in the art (Sambrook et al. (EDS) (2001) in "Molecular Cloning. A laboratory manual", Cold Spring Harbor Press Plainview, N.Y.).

The vaccine formulation of the present invention comprises an immunogen that induces an immune response directed against the cancer associated antigens such as the PCATs, and in nonhuman primates and finally in humans. The safety of the immunization procedures is determined by looking for the effect of immunization on the general health of the immunized animal (weight change, fever, appetite behavior etc.) and looking for pathological changes on autopsies. After initial testing in animals, cancer patients can be tested. Conventional methods would be used to evaluate the immune response of the patient to determine the efficiency of the vaccine.

Measurement of candidate disease tumor antigen or vaccine expression in patients is the first step of the present invention. Subsequent steps will focus on measuring immune responses to these candidate antigens or vaccine. Sera from disease patients, particularly cancer patients, and healthy donors will be screened for antibodies to the candidate antigens as well as for levels of circulating tumor derived antigens. antigen. The vaccine formulations may be evaluated first in animal models, initially rodents In one embodiment mammals, preferably human, at high risk for pancreatic diseases, particularly cancer, are prophylactically treated with the vaccines of this invention. Examples of such mammals include, but are not limited to, humans with a family history of pancreatic diseases, humans with a history of pancreatic diseases, particular cancer, or humans afflicted with pancreatic cancer previously resected and therefore at risk for reoccurrence. When provided therapeutically, the vaccine is provided to enhance the patient's own immune response to the diseased antigen present on the pancreatic diseases or advanced stage of pancreatic diseases. The vaccine, which acts as an immunogen, may be a cell, cell lysate from cells transfected with a recombinant expression vector, cell lysates from cells transfected with a recombinant expression vector, or a culture supernatant containing the expressed protein. Alternatively, the immunogen is a partially or substantially purified recombinant protein, peptide or analog thereof or modified peptides or analogs thereof. The proteins or peptides may be conjugated with lipoprotein or administered in liposomal form or with adjuvant.

While it is possible for the immunogen to be administered in a pure or substantially pure form, it is preferable to present it as a pharmaceutical composition, formulation or preparation. The formulations of the present invention are described in the previous section.

Vaccination can be conducted by conventional methods. For example, the immunogen can be used in a suitable diluent such as saline or water, or complete or incomplete adjuvants. Further, the immunogen may or may not be bound to a carrier to make the protein immunogenic. Examples of such carrier molecules include but are not limited to bovine serum albumin (BSA), keyhole limpet hemocyanin (KLH), tetanus toxoid, and the like. The immunogen also may be coupled with lipoproteins or administered in liposomal form or with adjuvants. The immunogen can be administered by any route-appropriate for antibody production such as intravenous, intraperitoneal, intramuscular, subcutaneous, and the like. The immunogen may be administered once or at periodic intervals until a significant titer of anti-PCAT immune cells or anti-PCAT antibody is produced. The presence of anti-PCAT immune cells may be assessed by measuring the frequency of precursor CTL (cytoxic T-lymphocytes) against PCAT antigen prior to and after immunization by a CTL precursor analysis assay (Coulie, P. et al., (1992) International Journal Of Cancer 50: 289-297). The antibody may be detected in the serum using the immunoassay described above.

The safety of the immunization procedures is determined by looking for the effect of immunization on the general health of the immunized animal. (weight change, fever, appetite behavior etc.) and looking for pathological changes on autopsies. After initial testing in animals, pancreatic diseases in patients can be tested. Conventional methods would be used to evaluate the immune response of the patient to determine the efficiency of the vaccine.

In yet another embodiment of this invention all, part, or parts of the PCAT proteins or peptides or fragments thereof, or modified peptides, may be exposed to dendritic cells cultured in vitro. The cultured dendritic cells provide a means of producing T-cell dependent antigens comprised of dendritic cell modified antigen or dendritic cells pulsed with antigen, in which the antigen is processed and expressed on the antigen activated dendritic cell. The PCAT antigen activated dendritic cells or processed dendritic cell antigens may be used as immunogens for vaccines or for the treatment of pancreatic diseases, particularly pancreatic cancer. The dendritic cells should be exposed to antigen for sufficient time to allow the antigens to be internalized and presented on the dendritic cells surface. The resulting dendritic cells or the dendritic cell process antigens can than be administered to an individual in need of therapy. Such methods are described in Steinman et al. (WO93/208185) and in Banchereau et al. (EPO Application 0563485A1).

In yet another aspect of this invention T-cells isolated from individuals can be exposed to the PCAT proteins, peptides or fragments thereof, or modified peptides in vitro and then administered to a patient in need of such treatment in a therapeutically effective amount. Examples of where T-lymphocytes can be isolated include but are not limited to, peripheral blood cells lymphocytes (PBL), lymph nodes, or tumor infiltrating lymphocytes (TIL). Such lymphocytes can be isolated from the individual to be treated or from a donor by methods known in the art and cultured in vitro (Kawakami, Y. et al. (1989) J. Immunol. 142: 2453-3461). Lymphocytes are cultured in media such as RPMI or RPMI 1640 or AIM V for 1-10 weeks. Viability is assessed by trypan blue dye exclusion assay. Examples of how these sensitized T-cells can be administered to the mammal include but are not limited to, intravenously, intraperitoneally or intralesionally. Parameters that may be assessed to determine the efficacy of these sensitized T-lymphocytes include, but are not limited to, production of immune cells in the mammal being treated or tumor regression. Conventional methods are used to assess these parameters. Such treatment can be given in conjunction with cytokines or gene modified cells (Rosenberg, S. A. et al. (1992) Human Gene Therapy, 3: 75-90; Rosenberg, S. A. et al. (1992) Human Gene Therapy, 3: 57-73).

The present invention is further described by the following example. The example is provided solely to illustrate the invention by reference to specific embodiments. This exemplification, while illustrating certain aspects of the invention, does not offer the limitations or circumscribe the scope of the disclosed invention.

All examples outlined here were carried out using standard techniques, which are well known and routine to those of skill in the art. Routine molecular biology techniques of the following example can be carried out as described in standard laboratory manuals, such as Sambrook et al., Molecular Cloning: A laboratory Manual, $3^{rd}$ Ed.; Cold Spring Harbor Laboratory, Cold Spring Harbor, N.Y. (2001).

WORKING EXAMPLES

1. Pancreatic Cell Line Model System

Analysis of gene expression in various pancreatic cancer cell lines as well as pancreatic duct epithelial tissue has shown that the cell line Hs766T correlates well with normal tissue. For this reason, this cell line is reported in the literature as being a good surrogate for normal tissue in analyses of differential expression between pancreatic adenomcarcinoma (and derived tumor lines) and normal tissue (or surrogate, Hs766T). The model system employed here involves the use of Hs766T as a "normal" reference to which cell surface expression in tumor derived cell lines is compared. These differentials or candidates are then validated in tissues, pancreatic cancer and normal pancreas, to confirm that they are differentially expressed between these tissues as well as within the cell line model system. Details of the pancreatic tumor lines that were used for this study, as well as the pancreatic line Hs766T are provided below.

fied by restriction digest. Subsequently, the isolated plasmid DNA was sequence verified against the ORF reference sequence. Sequencing reactions were carried out using Applied Biosystems BigDye Terminator kit followed by ethanol precipitation. Sequence data was collected using the

TABLE 3

Cell Lines and Media

| Cell line | ATCC Reference | Base medium | Glutamine | Non-essential amino acids | Sodium Carbonate | Sodium Pyruvate | Hepes | Fetal Bovine Serum |
|---|---|---|---|---|---|---|---|---|
| Panc-1 | CRL-1469 | DMEM | 2 mM | 1% (w/v) | 0.1% (w/v) | 1 mM | | 10% (v/v) |
| Hs766t | HTB-134 | DMEM | 2 mM | 1% (w/v) | 0.1% (w/v) | 1 mM | | 10% (v/v) |
| SU.86.86 | CRL-1837 | DMEM | 2 mM | 1% (w/v) | 0.1% (w/v) | 1 mM | | 10% (v/v) |
| AsPC1 | CRL-1682 | RPMI | 2 mM | 1% (w/v) | 0.1% (w/v) | 1 mM | 10 mM | 20% (v/v) |
| HPAF II | CRL-1997 | DMEM | 2 mM | 1% (w/v) | 0.1% (w/v) | 1 mM | | 10% (v/v) |
| HPAC | CRL-2119 | DMEM | 2 mM | 1% (w/v) | 0.1% (w/v) | 1 mM | | 10% (v/v) |
| Mia-Paca-2 | CRL-1420 | DMEM | 2 mM | 1% (w/v) | 0.1% (w/v) | 1 mM | | 10% (v/v) |
| Mpanc-96 | CRL-2380 | RPMI | 2 mM | 1% (w/v) | 0.1% (w/v) | 1 mM | 10 mM | 10% (v/v) |
| BxPC-3 | CRL-1687 | RPMI | 2 mM | 1% (w/v) | 0.1% (w/v) | 1 mM | 10 mM | 10% (v/v) |
| Capan-2 | HTB-80 | DMEM | 2 mM | 1% (w/v) | 0.1% (w/v) | 1 mM | | 10% (v/v) |

Pancreatic Cancer Cell Line Culture

Cell lines were grown in a culturing medium that is supplemented as necessary with growth factors and serum (as described in Table 3). Cultures were established from frozen stocks in which the cells were suspended in a freezing medium (cell culture medium with 10% DMSO [v/v]) and flash frozen in liquid nitrogen. Frozen stocks prepared in this way were stored in the liquid nitrogen vapour. Cell cultures were established by rapidly thawing frozen stocks at 37° C. Thawed stock cultures were slowly transferred to a culture vessel containing a large volume of culture medium that was supplemented. For maintenance of culture, cells were seeded at $1\times10^5$ cells/per ml in medium and incubated at 37° C. until confluence of cells in the culture vessel exceeds 50% by area. At this time, cells were harvested from the culture vessel using enzymes or EDTA where necessary. The density of harvested, viable cells was estimated by hemocytometry and the culture reseeded as above. A passage of this nature was repeated no more than 25 times at which point the culture was destroyed and reestablished from frozen stocks as described above.

For the analyses of cell surface protein expression in cultured cell lines cells were grown as described above. At a period 24 h prior to the experiment, the cell line was passaged as described above. This yielded cell densities that were <50% confluent and growing exponentially. Typically, triplicate analyses of differential expression were performed for each line relative to Hs766T for the purpose of identifying statistically significant reproducible differentially expressed proteins.

2. Cloning and Expression of Target Proteins cDNA Retrieval

Peptide sequences were searched by BlastP against the Celera Discovery System (CDS) and public database to identify the corresponding full-length open reading frames (ORFs). Each ORF sequence was then searched by BlastN against the Celera in-house human cDNA clone collection. For each sequence of interest, up to three clones were pulled and streaked onto LB/Ampicillin (100 ug/ml) plates. Plasmid DNA was isolated using Qiagen spin mini-prep kit and veri- Applied Biosystems 3100 Genetic Analyzer and analyzed by alignment to the reference sequence using the Clone Manager alignment tool.

PCR

PCR primers were designed to amplify the full-length ORF as well as any regions of the ORF that were interest for expression (antigenic or hydrophilic regions as determined by the Clone Manager sequence analysis tool). Primers also contained 5' and 3' overhangs to facilitate cloning (see below). PCR reactions contained 2.5 units Platinum Taq DNA Polymerase High Fidelity (Invitrogen), 50 ng cDNA plasmid template, 1 uM forward and reverse primers, 800 uM dNTP cocktail (Applied Biosystems) and 2 mM $MgSO_4$. After 20-30 cycles (94° C. for 30 seconds, 55° C. for 1 minutes and 73° C. for 2 minutes), product was verified and quantitated by agarose gel electrophoresis.

Construction of Entry Clones

PCR products were cloned into an entry vector for use with the Gateway recombination based cloning system (Invitrogen). These vectors included pDonr221, pDonr201, pEntr/D-TOPO or pEntr/SD/D-TOPO and were used as described in the cloning methods below.

TOPO Cloning into pEntr/D-TOPO or pEntr/SD/D-TOPO

For cloning using this method, the forward PCR primer contained a 5' overhang containing the sequence "CACC". PCR products were generated as described above and cloned into the entry vector using the Invitrogen TOPO cloning kit. Reactions were typically carried out at room temperature for 10 minutes and subsequently transformed into TOP10 chemically competent cells (Invitrogen, CA). Candidate clones were picked, plasmid DNA was prepared using Qiagen spin mini-prep kit and screened using restriction digest. Inserts were subsequently sequence verified as described above.

Gateway Cloning into pDonr201 or pDonr221

For cloning using this method, PCR primers contained the following overhangs: Forward 5' overhange:

5'-GGGGACAAGTTTGTAAAAAAGCAGGCTTC-3' (SEQ ID NO:874) Reverse 5' overhange:

5'-GGGGACCATTTGTACAAGAAAGCTGGGT-3' (SEQ ID NO:875)

PCR products were generated as described above. ORFs were recombined into the entry vector using the Invitrogen Gateway BP Clonase enzyme mix. Reactions were typically carried out at 25° C. for 1 hour, treated with Proteinase K at 37° C. for 10 minutes and transformed into Library Efficiency DH5α chemically competent cells (Invitrogen, CA). Candidate clones were picked, plasmid DNA was prepared using Qiagen spin mini-prep kit and screened using restriction digest. Inserts were subsequently sequence verified as described above.

Construction of Expression Clones

ORFs were transferred from the entry construct into a series of expression vectors using the Gateway LR Clonase enzyme mix. Reactions were typically carried out for 1 hour at 25° C., treated with Proteinase K at 37° C. for 10 minutes and subsequently transformed into Library Efficiency DH5α chemically competent cells (Invitrogen). Candidate clones were picked, plasmid DNA was prepared using Qiagen spin mini-prep kit and screened using restriction digest. Expression vectors included but were not limited to pDest14, pDest15, pDest17, pDest8, pDest10 and pDest20. These vectors allow expression in systems such as E. coli and recombinant baculovirus. Other vectors not listed here allow expression in yeast, mammalian cells, or in vitro.

Expression of Recombinant Proteins in E. coli

Constructs were transformed into one or more of the following host strains: BL21 SI, BL21 AI, (Invitrogen); Origami B (DE3), Origami B (DE3) pLysS, Rosetta (DE3), Rosetta (DE3) pLysS, Rosetta-Gami (DE3), Rosetta-Gami (DE3) pLysS, or Rosetta-Gami B (DE3) pLysS (Novagen). The transformants were grown in LB with or without NaCl and with appropriate antibiotics, at temperatures in the range of 20-37° C., with aeration. Expression was induced with the addition of IPTG (0.03-0.3 mM) or NaCl (75-300 mM) when the cells were in mid-log growth. Growth was continued for one to 24 hours post-induction. Cells were harvested by centrifugation in a Sorvall RC-3 C centrifuge in a H6000A rotor for 10 minutes at 3000 rpm, at 4° C. Cell pellets were stored at −80° C.

Expression of Recombinant Proteins Using Baculovirus

Recombinant proteins were expressed using baculovirus in Sf21 fall army worm ovarian cells. Recombinant baculoviruses were prepared using the Bac-to-Bac system (Invitrogen) per the manufacturer's instructions. Proteins were expressed on the large scale in Sf900II serum-free medium (Invitrogen) in a 10 L bioreactor tank (27° C., 130 rpm, 50% dissolved oxygen for 48 hours).

3. Recombinant Protein Purification

Recombinant proteins were purified from E. coli and/or insect cells using a variety of standard chromatography methods. Briefly, cells were lysed using sonication pr detergents. The insoluble material was pelleted by centrifugation at 10,000×g for 15 minutes. The supernatant was applied to an appropriate affinity column, e.g. His-tagged proteins were separated using a pre-packed chelating sepharose column (Pharmacia) or GST-tagged proteins were separated using a glutathione sepharose column (Pharmacia). After using the affinity column, proteins were further separated using various techniques, such as ion exchange chromatography (columns from Pharmacia) to separate on the basis of electrical charge or size exclusion chromatography (columns from Tosohaas) to separate on the basis of molecular weight, size and shape.

Expression and purification of the protein are also achieved using either a mammalian cell expression system or an insect cell expression system. The pUB6/V5-His vector system (Invitrogen, CA) is used to express GSCC in CHO cells. The vector contains the selectable bsd gene, multiple cloning sites, the promoter/enhancer sequence from the human ubiquitin C gene, a C-terminal V5 epitope for antibody detection with anti-V5 antibodies, and a C-terminal polyhistidine (6.times.His) sequence for rapid purification on PROBOND resin (Invitrogen, CA). Transformed cells are selected on media containing blasticidin.

Spodoptera frugiperda (Sf9) insect cells are infected with recombinant Autographica californica nuclear polyhedrosis virus (baculovirus). The polyhedrin gene is replaced with the cDNA by homologous recombination and the polyhedrin promoter drives cDNA transcription. The protein is synthesized as a fusion protein with 6× his, which enables purification as described above. Purified protein is used in the following activity and to make antibodies 4. Chemical Synthesis of Peptides Proteins or portions thereof may be produced not only by recombinant methods, but also by using chemical methods well known in the art. Solid phase peptide synthesis may be carried out in a batchwise or continuous flow process, which sequentially adds .alpha.-amino- and side chain-protected amino acid residues to an insoluble polymeric support via a linker group. A linker group such as methylamine-derivatized polyethylene glycol is attached to poly(styrene-co-divinylbenzene) to form the support resin. The amino acid residues are N-a-protected by acid labile Boc (t-butyloxycarbonyl) or base-labile Fmoc (9-fluorenylmethoxycarbonyl). The carboxyl group of the protected amino acid is coupled to the amine of the linker group to anchor the residue to the solid phase support resin. Trifluoroacetic acid or piperidine are used to remove the protecting group in the case of Boc or Fmoc, respectively. Each additional amino acid is added to the anchored residue using a coupling agent or pre-activated amino acid derivative, and the resin is washed. The full length peptide is synthesized by sequential deprotection, coupling of derivitized amino acids, and washing with dichloromethane and/or N,N-dimethylformamide. The peptide is cleaved between the peptide carboxy terminus and the linker group to yield a peptide acid or amide. (Novabiochem 1997/98 Catalog and Peptide Synthesis Handbook, San Diego Calif. pp. S1-S20). Automated synthesis may also be carried out on machines such as the 431A peptide synthesizer (ABI). A protein or portion thereof may be purified by preparative high performance liquid chromatography and its composition confirmed by amino acid analysis or by sequencing (Creighton (1984) Proteins, Structures and Molecular Properties, W H Freeman, New York N.Y.).

5. Antibody Development

Polyclonal Antibody Preparations:

Polyclonal antibodies against recombinant proteins were raised in rabbits (Green Mountain Antibodies, Burlington, Vt.). Briefly, two New Zealand rabbits were immunized with 0.1 mg of antigen in complete Freund's adjuvant. Subsequent immunizations were carried out using 0.05 mg of antigen in incomplete Freund's adjuvant at days 14, 21 and 49. Bleeds were collected and screened for recognition of the antigen by solid phase ELISA and western blot analysis. The IgG fraction was separated by centrifugation at 20,000×g for 20 minutes followed by a 50% ammonium sulfate cut. The pelleted protein was resuspended in 5 mM Tris and separated by ion exchange chromatography. Fractions were pooled based on IgG content. Antigen-specific antibody was affinity purified using Pierce AminoLink resin coupled to the appropriate antigen.

Isolation of Antibody Fragments Directed Against PCATs from a Library of scFvs

Naturally occurring V-genes isolated from human PBLs are constructed into a library of antibody fragments which contain reactivities against PCAT to which the donor may or may not have been exposed (see e.g., U.S. Pat. No. 5,885,793 incorporated herein by reference in its entirety).

Rescue of the Library: A library of scFvs is constructed from the RNA of human PBLs as described in PCT publication WO 92/01047. To rescue phage displaying antibody fragments, approximately 109 $E.$ $coli$ harboring the phagemid are used to inoculate 50 ml of 2× TY containing 1% glucose and 100 .mu.g/ml of ampicillin (2.times.TY-AMP-GLU) and grown to an O.D. of 0.8 with shaking. Five ml of this culture is used to innoculate 50 ml of 2.times.TY-AMP-GLU, 2×108 TU of delta gene 3 helper (M13 delta gene III, see PCT publication WO 92/01047) are added and the culture incubated at 37° C. for 45 minutes without shaking and then at 37° C. for 45 minutes with shaking. The culture is centrifuged at 4000 r.p.m. for 10 min. and the pellet resuspended in 2 liters of 2×TY containing 100 .mu.g/ml ampicillin and 50 ug/ml kanamycin and grown overnight. Phage are prepared as described in PCT publication WO 92/01047.

M13 delta gene IIIis prepared as follows: M13 delta gene III helper phage does not encode gene III protein, hence the phage(mid) displaying antibody fragments have a greater avidity of binding to antigen. Infectious M113 delta gene III particles are made by growing the helper phage in cells harboring a pUC19 derivative supplying the wild type gene III protein during phage morphogenesis. The culture is incubated for 1 hour at 37° C. without shaking and then for a further hour at 37° C. with shaking. Cells are spun down (IEC-Centra 8,400 r.p.m. for 10 min), resuspended in 300 ml 2×TY broth containing 100 .mu.g ampicillin/ml and 25 .mu.g kanamycin/ml (2×TY-AMP-KAN) and grown overnight, shaking at 37° C. Phagre particles are purified and concentrated from the culture medium by two PEG-precipitations (Sambrook et al., 2001), resuspended in 2 ml PBS and passed through a 0.45 .mu.m filter (MINISART NML; Sartorius) to give a final concentration of approximately 1013 transducing units/ml (ampicillin-resistant clones).

Panning of the Library: Immunotubes (Nunc) are coated overnight in PBS with 4 ml of either 100 .mu.g/ml or 10 .mu.g/ml of a polypeptide of the present invention. Tubes are blocked with 2% Marvel-PBS for 2 hours at 37° C. and then washed 3 times in PBS. Approximately 1013 TU of phage is applied to the tube and incubated for 30 minutes at room temperature tumbling on an over and under turntable and then left to stand for another 1.5 hours. Tubes are washed 10 times with PBS 0.1% Tween-20 and 10 times with PBS. Phage are eluted by adding 1 ml of 100 mM triethylamine and rotating 15 minutes on an under and over turntable after which the solution is immediately neutralized with 0.5 ml of 1.0M Tris-HCl, pH 7.4. Phages are then used to infect 10 ml of mid-log $E.$ $coli$ TG1 by incubating eluted phage with bacteria for 30 minutes at 37° C. The $E.$ $coli$ are then plated on TYE plates containing 1% glucose and 100 .mu.g/ml ampicillin. The resulting bacterial library is then rescued with delta gene 3 helper phage as described above to prepare phage for a subsequent round of selection. This process is then repeated for a total of 4 rounds of affinity purification with tube-washing increased to 20 times with PBS, 0.1% Tween-20 and 20 times with PBS for rounds 3 and 4.

Characterization of Binders: Eluted phage from the 3rd and 4th rounds of selection are used to infect $E.$ $coli$ HB 2151 and soluble scFv is produced (Marks, et al., 1991) from single colonies for assay. ELISAs are performed with microtitre plates coated with either 10 .mu.g/ml of the polypeptide of the present invention in 50 mM bicarbonate pH 9.6. Clones positive in ELISA are further characterized by PCR fingerprinting (see, e.g., PCT publication WO 92/01047) and then by sequencing.

Monoclonal Antibody Generation i) Materials:

Complete Media No Sera (CMNS) for washing of the myeloma and spleen cells; Hybridoma medium CM-HAT{Cell Mab (BD), 10% FBS (or HS); 5% Origen HCF (hybridoma cloning factor) containing 4 mM L-glutamine and antibiotics} to be used for plating hybridomas after the fusion.

2) Hybridoma medium CM-HT (NO AMINOPTERIN) (Cell Mab (BD), 10% FBS 5% Origen HCF containing 4 mM L-glutamine and antibiotics) to be used for fusion maintenance are stored in the refrigerator at 4-6° C. The fusions are fed on days 4, 8, and 12, and subsequent passages. Inactivated and pre-filtered commercial Fetal Bovine serum (FBS) or Horse Serum (HS) are thawed and stored in the refrigerator at 4° C. and must be pretested for myeloma growth from single cells.

The L-glutamine (200 mM, 100× solution), which is stored at −20° C. freezer, is thawed and warmed until completely in solution. The L-glutamin is dispensed into media to supplement growth. L-glutamin is added to 2 mM for myelomas, and 4 mM for hybridoma media. Further the Penicillin, Streptomycin, Amphotericin (antibacterial-antifungal stored at −20° C.) is thawed and added to Cell Mab Media to 1%.

4) Myeloma growth media is Cell Mab Media (Cell Mab Media, Quantum Yield from BD is stored in the refrigerator at 4° C. in the dark) which are added L-glntamine to 2 mM and antibiotic/antimycotic solution to 1% and is called CMNS.

5) 1 bottle of PEG 1500 in Hepes (Roche, N.J.)

6) 8-Azaguanine is stored as the dried powder supplied by SIGMA at −700° C. until needed. Reconstitute 1 vial/500 ml of media and add entire contents to 500 ml media (eg. 2 vials/liter).

7) Myeloma Media is CM which has 10% FBS (or HS) and 8-Aza (1×) stored in the refrigerator at 4° C.

8) Clonal cell medium D (Stemcell, Vancouver) contains HAT and methyl cellulose for semi-solid direct cloning from the fusion.

9) Hybridoma supplements HT [hypoxanthine, thymidine] are to be used in medium for the section of hybridomas and maintenace of hybridomas through the cloning stages respectively.

10) Origen HCF can be obtained directly from Igen and is a cell supernatant produced from a macrophage-like cell-line. It can be thawed and aliqouted to 15 ml tubes at 5 ml per tube and stored frozen at −20° C. Positive Hybridomas are fed HCF through the first subcloning and are gradually weaned. It is not necessary to continue to supplement unless you have a particularly difficult hybridoma clone. This and other additives have been shown to be more effective in promoting new hybridoma growth than conventional feeder layers.

ii) Procedure

To generate monoclonal antibodies, mice are immunized with 5-50 ug of antigen either intra-peritoneally (i.p.) or by intravenous injection in the tail vein (i.v.). Typically, the antigen used is a recombinant protein that is generated as described above. The primary immunization takes place 2 months prior to the harvesting of splenocytes from the mouse and the immunization is typically boosted by i.v. injection of 5-50 ug of antigen every two weeks. At least one week prior to expected fusion date, a fresh vial of myeloma cells is thawed and cultured. Several flasks at different densities are maintained in order that a culture at the optimum density is ensured at the time of fusion. The optimum density is determined to be 3-6×10$^5$ cells/ml. Two to five days before the scheduled fusion, a final immunization is administered of ~5 ug of antigen in PBS i.p. or i.v.

Myeloma cells are washed with 30 ml serum free media by centrifugation at 500×g at 4° C. for 5 minutes. Viable cell density is determined in resuspended cells using hemocytometry and vital stains. Cells resuspended in complete growth medium are stored at 37° C. during the preparation of splenocytes. Meanwhile, to test aminopterin sensitivity, 1×06 myeloma cells are transferred to a 15 ml conical tube and centrifuged at 500 g at 4° C. for 5 minutes. The resulting pellet is resuspended in 15 ml of HAT media and cells plated at 2 drops/well on a 96 well plate.

To prepare splenocytes from immunized mice, the animals are euthanised and submerged in 70% EtOH. Under sterile conditions, the spleen is surgically removed and placed in 10 ml of RPMI medium supplemented with 20% fetal calf serum in a Petri dish. Cells are extricated from the spleen by infusing the organ with medium >50 times using a 21 g syringe.

Cells are harvested and washed by centrifugation (at 500×g at 4° C. for 5 minutes) with 30 ml of medium. Cells are resuspended in 10 ml of medium and the density of viable cells determined by hemocytometry using vital stains. The splenocytes are mixed with myeloma cells at a ratio of 5:1 (spleen cells: myeloma cells). Both the myeloma and spleen cells are washed 2 more times with 30 ml of RPMI-CMNS. Spin at 800 rpm for 12 minutes.

Supernatant is removed and cells are resuspended in 5 ml of RPMI-CMNS and are pooled to bring the volume to 30 ml and spun down as before. The cell pellet is broken up by gentle tapping and resuspended in 1 ml of BMB PEG1500 (prewarmed to 37° C.) added dropwise with 1 cc needle over 1 minute.

RPMI-CMNS is added to the PEG cells to slowly to dilute out the PEG. Cells are centrifuged and diluted in 5 ml of Complete media and 95 ml of Clonacell Medium D (HAT) media (with 5 ml of HCF). The cells are plated out at 10 ml per small Myeloma/HAT control is prepared as follows. Dilute about 1000 P3X63 Ag8.653 myeloma cells into 1 ml of medium D and transfer into a single well of a 24 well plate. Plates are placed in incubator, with two plates inside of a large petri plate, with an additional petri plate full of distilled water, for 10-18 days under 5% CO2 overlay at 37° C. Clones are picked from semisolid agarose into 96 well plates containing 150-200 ul of CM-HT. Supernatants are screened 4 days later in ELISA, and positive clones are moved up to 24 well plates. Heavy growth will require changing of the media at day 8 (+/−150 ml). One should further decrease the HCF to 0.5% (gradually—2%, then 1%, then 0.5%) in the cloning plates.

For further references see Kohler G, and C. Milstein Continuous cultures of fused cells secreting antibody of pre-defined specificity. 1975. Nature 256: 495-497; Lane, R. D. A short duration polyethylene glycol fusion technique for increasing production of monoclonal antibody-secreting hybridomas. 1985. J. Immunol. Meth. 81: 223-228;

Harlow, E. and D. Lane. Antibodies: A laboratory manual Cold Spring Harbour Laboratory Press. 1988; Kubitz, D. The Scripps Research Institute. La Jolla. Personal Communication; Zhong, G., Berry, J. D., and Choukri, S. (1996) Mapping epitopes of *Chlamydia trachomatis* neutralizing monoclonal antibodies using phage random peptide libraries. J. Indust. Microbiol. Biotech. 19, 71-76; Berry, J. D., Licea, A., Popkov, M., Cortez, X., Fuller, R., Elia, M., Kerwin, L., and C. F. Barbas III. (2003) Rapid monoclonal antibody generation via dendritic cell targeting in vivo. Hybridoma and Hybridomics 22 (1), 23-31.

6. Expression Validation mRNA Expression Validation by TAQMAN

Expression of mRNA was quantitated by RT-PCR using TaqMan® technology. The Taqman system couples a 5' fluorogenic nuclease assay with PCR for real time quantitation. A probe was used to monitor the formation of the amplification product.

Total RNA was isolated from cancer-niodel cell lines using the RNEasy kit® (Qiagen) per manufacturer's instructions and included DNase treatment. Normal human tissue RNAs were acquired from commercial vendors (Ambion, Austin, Tex.; Stratagene, La Jolla, Calif., BioChain Institute, Newington, N.H.) as were RNAs from matched disease/normal tissues.

Target transcript sequences were identified for the differentially expressed peptides by searching the BlastP database. TaqMan assays (PCR primer/probe set) specific for those transcripts were identified by searching the Celera Discovery System™ (CDS) database. The assays were designed to span exon-exon borders and do not amplify genomic DNA.

The TaqMan primers and probe sequences were as designed by Applied Biosystems (AB) as part of the Assays on Demand™ product line or by custom design through the AB Assays by Design$^{SM}$ service.

RT-PCR was accomplished using AmpliTaqGold and MultiScribe reverse transcriptase in the One Step RT-PCR Master Mix reagent kit (AB) according to the manufacturer's instructions. Probe and primer concentrations are 250 nM and 900 nM, respectively, in a 15 µl reaction. For each experiment, a master mix of the above components was made and aliquoted into each optical reaction well. Eight nanograms of total RNA was the template. Each sample was assayed in triplicate. Quantitative RT-PCR is performed using the ABI Prism® 7900HT Sequence Detection System (SDS). Cycling parameters follow: 48° C. for 30 min. for one cycle; 95° C. for 10 min for one cycle; 95° C. for 15 sec, 60° C. for 1 min. for 40 cycles.

The SDS software calculates the threshold cycle ($C_T$) for each reaction, and $C_T$ values were used to quantitate the relative amount of starting template in the reaction. The $C_T$ values for each set of three reactions were averaged for all subsequent calculations Data were analyzed for fold differences in expression using an endogenous control for normalization, and measuring expression expressed relative to a normal tissue or normal cell line reference. The choice of endogenous control was determined empirically by testing various candidates against the cell line and tissue RNA panels and selecting the one with the least variation in expression. Relative changes in expression were quantitated using the $2^{-\Delta\Delta C_T}$ Method. Livak, K. J. and Schmittgen, T. D. (2001) Methods 25: 402-408; User bulletin #2: ABI Prism: 7700 Sequence Detection System.

Protein Expression Validation by Westen

Western blot analysis of target proteins was carried out using whole cell extracts prepared from each of the pancreatic cell lines. To make cell extracts, the cells were resuspended in Lysis buffer (125 mM Tris, pH 7.5, 150 mM NaCl, 2% SDS, 5 mM EDTA, 0.5% NP-40) and passed through a 20-gauge needle. Lysates were centrifuged at 5,000×g for 5 minutes at 4° C. The supernatants were collected and a protease inhibitor cocktail (Sigma) was added. The Pierce BCA assay was used to quantitate total protein. Samples were separated by SDS-PAGE and transferred to either a nitrocellulose or PVDF membrane. The Western Breeze kit from Invitrogen was used for western blot analysis. Primary antibodies were either purchased from commercially available sources or prepared using one of the methods described in Section 5. For this application, antibodies were typically diluted 1:500 to 1:10,000 in diluent buffer. Blots were developed using Pierce NBT.

Results

Both mRNA expression and protein expression were performed and many targets were found to have a positive correlation between mRNA and protein expression relative to Hs766t. The expression of each of the targets was first analyzed in the pancreas cell line panel to show that in fact mRNA expression is also upregulated and that it correlates with the protein data obtained from the LC/MS. The exemplary targets are Muc4, Kunitz-1 protease inhibitor, Kunitz-2 protease inhibitor, Neutral amino acid transporter B(0), Transmembrane 4 superfamily member 3, KIAA 1363, Gs3786, HSPC as well as Tissue Factor.

In addition to Hs766t, mRNAs from normal pancreas tissue or other normal tissues were obtained for control. The targets listed above showed high mRNA expression in pancreatic cancer cell line. Moreover, mRNAs from pancreatic tumors were analysed and were shown to be overexpressed in target such as TM4SF3.

Figure 4:
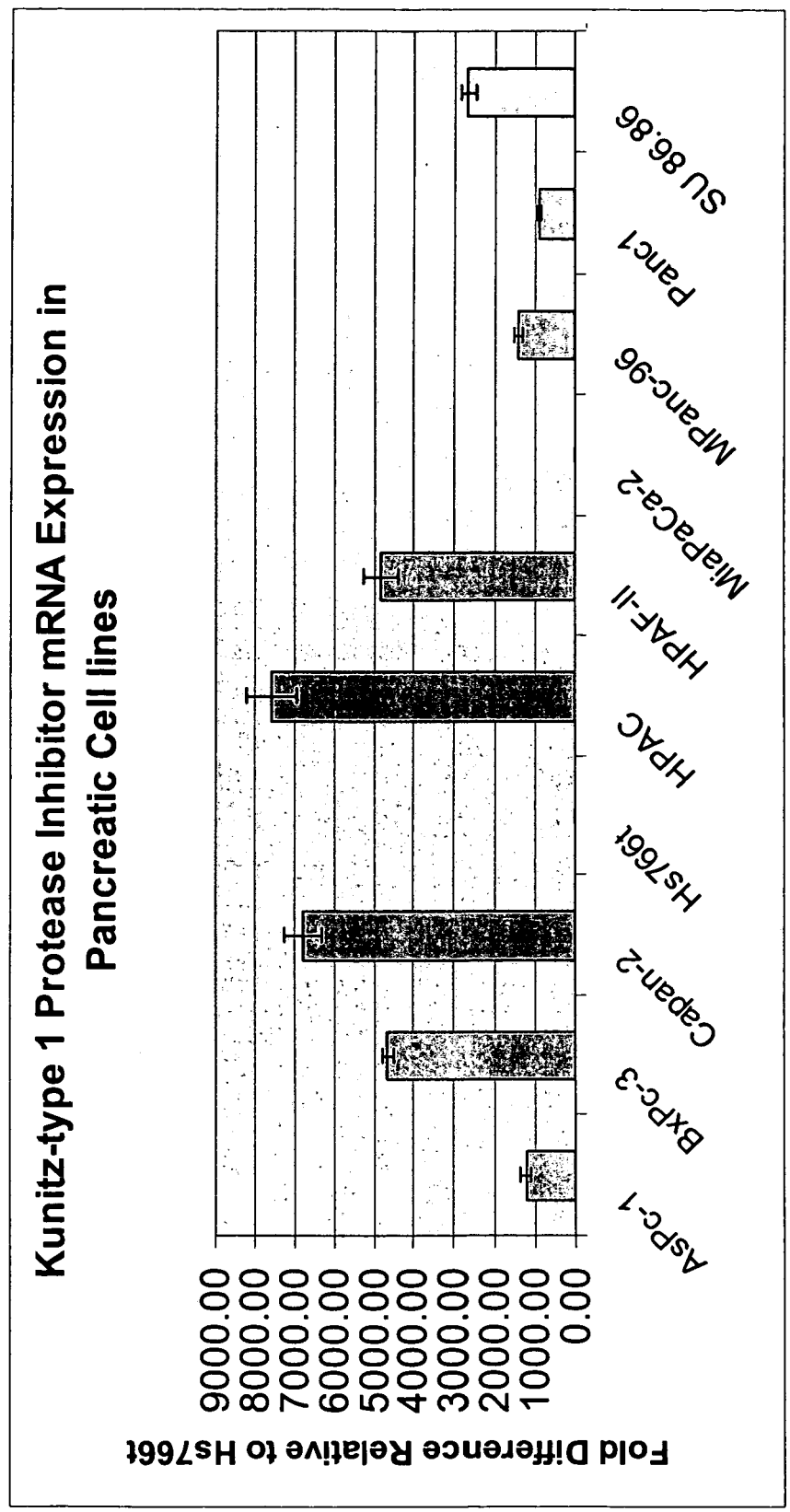
FIG. 4. Kunitz-type 1 protease inhibitor mRNA expression in pancreatic cell lines. Kunitz-type 1 protease inhibitor mRNA expression was measured across the pancreatic cell line panel and calculated as fold difference from the reference cell line Hs766t. mRNA expression was found to be overexpressed in several of the cell lines relative to Hs766t, including the SU.86.86 cell line consistent ICAT data collected by mass spectrometry.

FIG. 4 shows the Kunitz-type 1 protease inhibitor mRNA expression in pancreatic cell lines. By using Hs766t as a control, the result shows that Kunitz—type 1 protease inhibitor is overexpressed in AsPc-1, BxPc-3, Capan-2, HPAC, HPAF-II, MPanc-96, Panc1 as well as SU 86.86. Moreover, the data is also consistent with the result from detection of the target by using LC/MS with ICAT labeling (see the method below).

Figure 10:
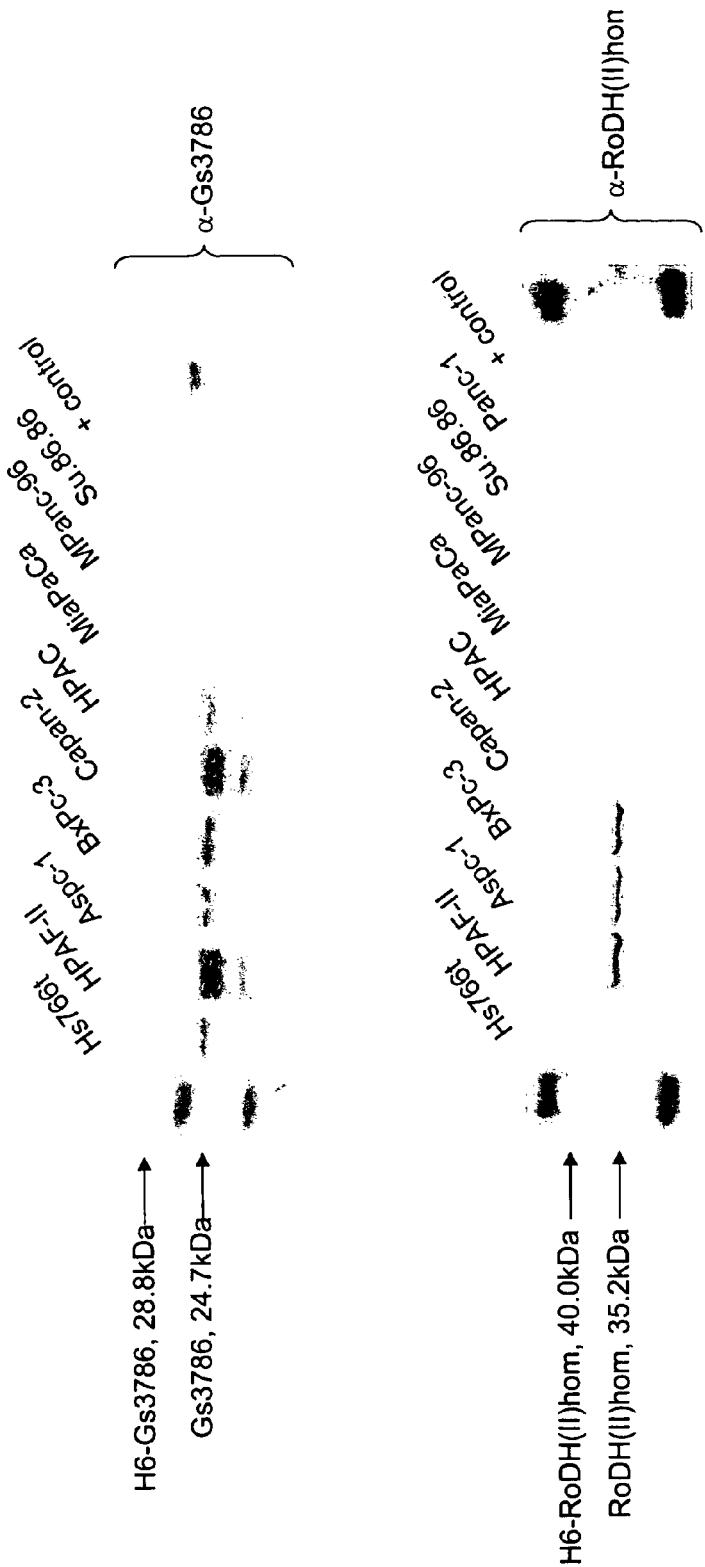

FIG. 10 shows that both Gs3786 and Retinol Dehydrogenase Type II homolog were found to be over-expressed in several cell lines relative to the reference cell line Hs766t.

Tissue Flow Cytometry Analysis

Post tissue processing, cells were sorted by flow cytometry known in the art to enrich for epithelial cells. Alternatively, cells isolated from pancratic tissue were stained directly with EpCAM (for epithelial cells) and the specific antibody to PCAT. Cell numbers and viability were determined by PI exclusion (GUAVA) for cells isolated from both normal and tumor pancreatic tissue. A minimum of $0.5 \times 10^6$ cells were used for each analysis. Cells were washed once with Flow Staining Buffer (0.5% BSA, 0.05% NaN3 in D-PBS). To the cells, 20 ul of each antibody for PCAT were added. An additional 5 ul of EpCAM antibody conjugated to APC were added when unsorted cells were used in the experiment. Cells were incubated with antibodies for 30 minutes at 4° C. Cells were washed once with Flow Staining Buffer and either analyzed immediately on the LSR flow cytometry apparatus or fixed in 1% formaldehyde and store at 4° C. until LSR analysis. The antibodies used to detect PCAT targets were all purchased by BD Biosciences and PE-conjugated. The isotype control antibody used for these experiments was PE-conjugated mouse IgG1k.

Tumors tissue from pancreatic cancer and from Xenograft mouse pancreatic tissues were obtained and detected via Flow Cytometry analysis. Tissue factor was shown to be overexpressed among the pancreatic tumor tissues (data not shown). Xenograft mouse was obtained by using cultured human BXPC pancreatic cells (ATCC) that were injected subcutaneously in BALB nude mouse. The pancreatic tumors were obtained from the xenograft mouse for further FACS study.

7. Detection and Diagnosis of PCAT by Liquid Chromatography and Mass Spectrometry (LC/MS)

The differential expression of proteins in disease and healthy samples are quantitated using Mass Spectrometry and ICAT (Isotope Coded Affinity Tag) labeling, which is known in the art. ICAT is an isotope label technique that allows for discrimination between two populations of proteins, such as a healthy and a disease sample that are pooled together for experimental purposes or two acquisitions of the same sample for classification of true sample peptides from LC/MS noise artifacts. The LC/MS spectra are collected for the labeled samples and processed using the following steps:

The raw scans from the LC/MS instrument are subjected to peak detection and noise reduction software. Filtered peak lists are then used to detect "features" corresponding to specific peptides from the original sample(s). Features are characterized by their mass/charge, charge, retention time, isotope pattern and intensity.

Similar experiments can be repeated in order to increase the confidence in detection of a peptide. These multiple acquisitions are computationally aggregated into one experiment. Experiments involving healthy and disease samples use the known effects of the ICAT label to classify the peptides as originating from a particular sample or from both samples. The intensity of a peptide present in both healthy and disease samples is used to calculate the differential expression, or relative abundance, of the peptide. The intensity of a peptide found exclusively in one sample is used to calculate a theoretical expression ratio for that peptide (singleton). Expression ratios are calculated for each peptide of each replicate of the experiment (for example, Table 1).

Statistical tests are performed to assess the robustness of the data and select statistically significant differentials. To assess general quality of the data, one: a) ensure that similar features are detected in all replicates of the experiment; b) assess the distribution of the log ratios of all peptides (a Gaussian was expected); c) calculate the overall pair wise correlations between ICAT LC/MS maps to ensure that the expression ratios for peptides are reproducible across the multiple replicates; d) aggregate multiple experiments in order to compare the expression ratio of a peptide in multiple diseases or disease samples.

8. Expression Validation by IHC in Tissue Sections

Tissue Sections

Paraffin embedded, fixed tissue sections were obtained from a panel of normal tissues (Adrenal, Bladder, Lymphocytes, Bone Marrow, Breast, Cerebellum, Cerebral cortex, Colon, Endothelium, Eye, Fallopian tube, Small Intestine, Heart, Kidney [glomerulus, tubule], Liver, Lung, Testes and Thyroid) as well as 30 tumor samples with matched normal adjacent tissues from pancreas, lung, colon, prostate, ovarian and breast. In addition, other tissues are selected for testing such as bladder renal, hepatocellular, pharyngeal and gastric tumor tissues.

Esophageal replicate sections were also obtained from numerous tumor types (Bladder Cancer, Lung Cancer, Breast Cancer, Melanoma, Colon Cancer, Non-Hodgkins Lymphoma, Endometrial Cancer, Ovarian Cancer, Head and Neck Cancer, Prostate Cancer, Leukemia [ALL and CML] and Rectal Cancer). Sections were stained with hemotoxylin and eosin and histologically examined to ensure adequate representation of cell types in each tissue section.

An identical set of tissues will be obtained from frozen sections and are used in those instances where it is not possible to generate antibodies that are suitable for fixed sections. Frozen tissues do not require an antigen retrieval step.

Paraffin Fixed Tissue Sections

Hemotoxylin and Eosin staining of paraffin embedded, fixed tissue sections. Sections were deparaffinized in 3 changes of xylene or xylene substitute for 2-5 minutes each. Sections were rinsed in 2 changes of absolute alcohol for 1-2 minutes each, in 95% alcohol for 1 minute, followed by 80% alcohol for 1 minute. Slides were washed well in running water and stained in Gill solution 3 hemotoxylin for 3 to 5 minutes. Following a vigorous wash in running water for 1 minute, sections were stained in Scott's solution for 2 minutes. Sections were washed for 1 min in running water then conterstained in Eosin solution for 2-3 minutes depending upon development of desired staining intensity. Following a brief wash in 95% alcohol, sections were dehydrated in three changes of absolute alcohol for 1 minute each and three changes of xylene or xylene substitute for 1-2 minutes each. Slides were coverslipped and stored for analysis.

Optimisation of Antibody Staining

For each antibody, a positive and negative control sample was generated using data from the ICAT analysis of the pancreatic cancer cell lines. Cell lines were selected that are known to express low levels of a particular target as determined from the ICAT data. This cell line was the reference normal control "Hs766T". Similarly, a pancreatic tumour line was selected that was determined to overexpress the target was selected.

Antigen Retrieval

Sections were deparaffinized and rehydrated by washing 3 times for 5 minutes in xylene; two times for 5 minutes in 100% ethanol; two times for 5 minutes in 95% ethanol; and once for 5 minutes in 80% ethanol. Sections were then placed in endogenous blocking solution (methanol+2% hydrogen peroxide) and incubated for 20 minutes at room temperature. Sections were rinsed twice for 5 minutes each in deionized water and twice for 5 minutes in phosphate buffered saline (PBS), pH 7.4. Alternatively, where necessary sections were deparrafinized by High Energy Antigen Retrieval as follows: sections were washed three times for 5 minutes in xylene; two times for 5 minutes in 100% ethanol; two times for 5 minutes in 95% ethanol; and once for 5 minutes in 80% ethanol. Sections were placed in a Coplin jar with dilute antigen retrieval solution (10 mM citrate acid, pH 6). The Coplin jar containing slides was placed in a vessel filled with water and microwaved on high for 2-3 minutes (700 watt oven). Following cooling for 2-3 minutes, steps 3 and 4 were repeated four times (depending on tissue), followed by cooling for 20 minutes at room temperature. Sections were then rinsed in deionized water, two times for 5 minutes, placed in modified endogenous oxidation blocking solution (PBS+2% hydrogen peroxide) and rinsed for 5 minutes in PBS.

Blocking and Staining

Sections were blocked with PBS/1% bovine serum albumin (PBA) for 1 hour at room temperature followed by incubation in normal serum diluted in PBA (2%) for 30 minutes at room temperature to reduce non-specific binding of antibody. Incubations were performed in a sealed humidity chamber to prevent air-drying of the tissue sections. (The choice of blocking serum was the same as the species of the biotinylated secondary antibody). Excess antibody is gently removed by shaking and sections covered with primary antibody diluted in PBA and incubated either at room temperature for 1 hour or overnight at 4° C. (Care was taken that the sections do not touch during incubation). Sections were rinsed twice for 5 minutes in PBS, shaking gently. Excess PBS was removed by gently shaking. The sections were covered with diluted biotinylated secondary antibody in PBA and incubated for 30 minutes to 1 hour at room temperature in the humidity chamber. If using a monoclonal primary antibody, addition of 2% rat serum was used to decrease the background on rat tissue sections. Following incubation, sections were rinsed twice for 5 minutes in PBS, shaking gently. Excess PBS was removed and sections incubated for 1 hour at room temperature in Vectastain ABC reagent (as per kit instructions). The lid of the humidity chamber was secured during all incunations to ensure a moist environment. Sections were rinsed twice for 5 minutes in PBS, shaking gently.

Develop and Counterstain

Sections were incubated for 2 minutes in peroxidase substrate solution that was made up immediately prior to use as follows: 10 mg diaminobenzidine (DAB) dissolved in 10 ml 50 mM sodium phosphate buffer, pH 7.4; 12.5 microliters 3% $CoCl_2/NiCl_2$ in deionized water; 1.25 microliters hydrogen peroxide Slides were rinsed well three times for 10 min in deionized water and counterstained with 0.01% Light Green acidified with 0.01% acetic acid for 1-2 minutes depending on intensity of counterstain desired.

Slides were rinsed three times for 5 minutes with deionized water and dehydrated two times for 2 minutes in 95% ethanol; two times for 2 minutes in 100% ethanol; and two times for 2 minutes in xylene. Stained slides were mounted for visualization by microscopy.

Results

Tissue Factor: The protein was overexpressed in fourteen out of twenty two pancreatic tumor and two out seven pancreatic tumor metastases. In normal tissues, antibody to tissue factor or CD142 showed minimal staining. Occasional cytoplasmic staining was present in subsets of inflammatory cells, specifically lymphocytes and mast cells. Gastric chief cells showed cytoplasmic and nuclear staining. Many cell types and tissues, including urothelium, breast epithelium, respiratory epithelium, adrenal cortex, ovarian stroma, endometrial stroma, pancreatic acinar epithelium, and placental trophoblasts showed focal nuclear staining. However, in contrast to normal tissues, a number of malignancies showed significant membranous and cytoplasmic staining in malignant cells among the tumor tissues. The most prominent positivity was identified in pancreatic carcinoma, followed by prostatic carcinoma. Individual samples of colon, lung, breast and ovarian carcinoma showed positive staining. The color scale or number scale indicates the color intensity of the staining. Each number represents 100% of staining of all the tumor cells at this staining scale (see FIG. 1). In addition, CD142 (tissue factor) is overexpressed by 2 pathology grades relative to normal comparative cell type in esophageal 10%, pharyngeal 20%, gastric 10%.

Decay Accelerating Factor (DAF: The protein was overexpressed in seven out of twenty-three pancreatic tumors. The target also overexpressed in colon cancer. DAF was overexpressed by 2 pathology grades in esophageal 20%, liver 30%, gastric 30%.

Mucin 4: Mucin 4 is a transmembrane mucin composed of two subunits (a and b) generated from proteolytic cleavage, wherein a is extracellular and b is transmembrane. The b subunit contains two EGF-like domains and interacts with ErbB2 and the ErbB2/ErbB3 heterodimer with the presence of neuregulin. Interaction with ErbB2 results phosphorylation of ErbB2 and upregulation of cyclin-dependent kinase inhibitor p27kip. The intereaction causes cell cycle arrest and epithelial cell differentiation. Interaction of Mucin 4 with ErbB2/B3 results in hyperphosphorylation of the ErbB2/ErbB3/NRG heterotrimer and activation of MAPK, PI3K pathways with downregulation of p27kip. This results in the stimulation of epithelial cell proliferation. Apoptosis is repressed by expression of Mucin 4 and tumor cell growth therefore stimulated.

Figure 3:
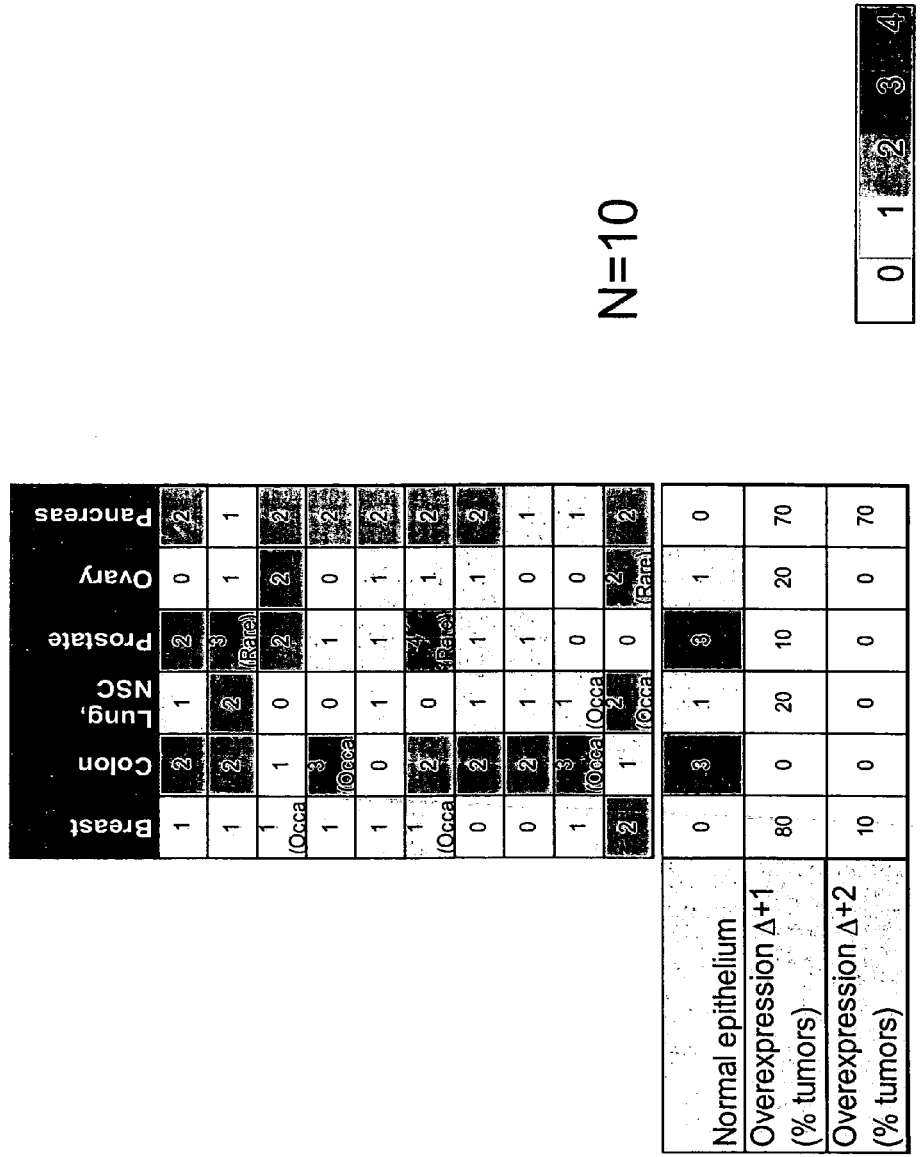
FIG. 3. Mucin 4 expression in various tumor types by immunohistochemistry.

In normal tissues, antibody to Mucin 4 showed the most prominent positive staining in colonic epithelium and scattered individual cells within the prostatic epithelium. Additional positive cell types included pancreatic islets, urothelium, astrocytes, gastric chief cells, and subsets of renal tubular epithelial cells. Focal positivity was present in the adrenal cortex, en dometrium, and testis. Rarely, inflammatory cells and single cells (neuroendocrine cells) in the intestinal epithelium were positive. Among malignancies tumor tissues, FIG. 3 showed that Mucin 4 protein is overexpressed in breast, non-small lung, prostate, ovarian and pancreatic cancers.

The Mucin 4 was overexpressed in fourteen out of twenty four pancreatic tumors and six out of eight metastatic tissues. The protein was expressed in several normal epithelia. However, both Mucin 4 and ErbB3 were overexpressed in pancreatic tumors. Mucin 4 was also overexpressed in breast cancer. In addition, Muc4 is overexpressed by 2 pathology grades in esophageal 80% (relative to gastric epithelium), renal cell carcinoma 90%, hepatocellular 20%, pharyngeal 70% (relative to gastric epithelium), gastric 20%.

ErbB3: The protein was specifically expressed in pancreatic tumor BxPC3 cell line and Breast cancer MCF7 cell line by Western analysis. Further IHC data showed that ErbB3 is overexpressed in 50% of pancreatic cancer, 30% ovarian cancer and 10% non-small cell lung cancer. Overlap of expression of Mucin 4 and ErbB3 was predominantly tumor specific where both are overexpressed.

Kunitz Inhibitor-1: the protein was overexpressed in thirteen out of twenty three pancreatic tumors and three out seven metastatic pancreatic cancer tissues. In normal tissues, antibody to Kunitz Inhibitor-1 or HAI-1 showed the most prominent positivity in placental trophoblasts. Colonic epithelium was also positive. Less intense positivity was present in urothelium and endometrial glands. Focal positivity was present in breast epithelium, respiratory epithelium, centroacinar cells in the pancreas, subsets of renal tubular epithelial cells, tonsillar epithelium, and hepatic bile ducts. However, in tumor tissues, a majority of samples of all subtypes tested showed positive staining of malignant cells. The staining was often membranous and diffused within the samples. A few samples of breast and lung cancer contained adjacent benign epithelium, which showed significantly less intense staining than the malignant cells. In pancreatic carcinoma, the level of staining in malignant cells was frequently similar to that in benign centroacinar cells, but in a few cases, the staining was less intense in malignant cells than in the adjacent benign epithelium. FIG. 2 concludes that Kunitz inhibitor-1 was overexpressed in breast, non-small cell lung, prostate, ovarian as well as pancreatic cancers. In addition, Kunitz-1 is overexpressed by 2 pathology grades in: esophageal 40%, renal cell carcinoma 40%, hepatocellular 25%, pharyngeal 30%, gastric 40%.

Transglutaminase-2 (TGM2): TGM2 protein was overexpressed in seventeen out of twenty four pancreatic tumors and seven out of seven metastatic tissues. Pathology study noted overexpression in capilliary endothelium including neovascular capillaries. TGM2 protein was also overexpressed in four out of ten ovarian tumors and overexpressed in non small cell lung tumor, prostate tumor. TGM2 was overexpressed by 2 pathology grades in esophageal 10%, renal 30%, liver 10%, pharyngeal 20%, gastric 10%.

Neutral Amino Acid Transporter (ASCT2): ASCT2 protein was overexpressed in sixteen out of twenty seven pancreatic tumors (60%) and four out of seven pancreatic metastatic tissues. The protein was also overexpressed in 40% prostate cancer and 30% ovarian cancer tissues. Neutral amino acid transporter is also overexpressed by 2 pathology grades in: esophageal 10% hepatocellular 75%

CD166: CD166 protein was overexpressed in 10% pancreatic, colon and ovarian tumor, in 50% overexpressed in breast tumors.

CD46: CD46 protein was overexpressed in 10% pancreatic tumor and in 30% non-small cell lung tumors.

Kunitz Type inhibitor-2 (HAI-2): HAI-2 was overexpressed in 40% pancreatic tumors and in 10% breast and ovarian tumors.

Na/K ATPase Beta-3: Na/K ATPase Beta-3 was overexpressed in pancreatic tumor, ovarian tumor.

GS3786: GS3786 was overexpressed in pancreatic tumor and prostate tumor.

Diminuto-like: Diminuto-like protein is overexpressed (by 2 pathology grades relative to normal comparative cell type) in 20% pancreatic, 40% prostate, 20% breast and 10% colon tumors 9. IHC Staining of Frozen Tissue Sections Fresh tissues are embedded carefully in OCT in plastic mold, without trapping air bubbles surrounding the tissue. Tissues are frozen by setting the mold on top of liquid nitrogen until 70-80% of the block turns white at which point the mold is placed on dry ice. The frozen blocks were stored at $-80°$ C. Blocks are sectioned with a cryostat with care taken to avoid warming to greater than $-10°$ C. Initially, the block is equilibrated in the cryostat for about 5 minutes and 6-10 mm sections are cut sequentially. Sections are allowed to dry for at least 30 minutes at room temperature. Following drying, tissues are stored at 4° C. for short term and $-80°$ C. for longterm storage.

Sections are fixed by immersing in acetone jar for 1-2 minutes at room temperature, followed by drying at room temperature. Primary antibody is added (diluted in 0.05 M Tris-saline [0.05 M Tris, 0.15 M NaCl, pH 7.4], 2.5% serum) directly to the sections by covering the section dropwise to cover the tissue entirely. Binding is carried out by incubation a chamber for 1 hour at room temperature. Without letting the sections dry out, the secondary antibody (diluted in Tris-saline/2.5% serum) is added in a similar manner to the primary and incubated as before (at least 45 minutes). Following incubation, the sections are washed gently in Tris-saline for 3-5 minutes and then in Tris-saline/2.5% serum for another 3-5 minutes. If a biotinylated primary antibody is used, in place of the secondary antibody incubation, slides are covered with 100 ul of diluted alkaline phosphatase conjugated streptavidin, incubated for 30 minutes at room temperature and washed as above. Sections are incubated with alkaline phosphatse substrate (1 mg/ml Fast Violet; 0.2 mg/ml Napthol AS-MX phosphate in Tris-Saline pH 8.5) for 10-20 minutes until the desired positive staining is achieved at which point the reaction is stopped by washing twice with Tris-saline. Slides are counter-stained with Mayer's hematoxylin for 30 seconds and washed with tap water for 2-5 minutes. Sections are mounted with Mount coverslips and mounting media.

10. Assay for Antibody Dependent Cellular Cytotoxicity

Cultured tumor cells are labeled with 100 $\mu$Ci $^{51}$Cr for 1 hour; Livingston, P. O., Zhang, S., Adluri, S., Yao, T.-J., Graeber, L., Ragupathi, G., Helling, F., & Fleischer, M. (1997). Cancer Immunol. Immunother. 43, 324-330. After washing three times with culture medium, cells are resuspended at $10^5$/ml, and 100 $\mu$l/well are plated onto 96-well round-bottom plates. A range of antibody concentrations are applied to the wells, including an isotype control together with donor peripheral blood mononuclear cells that are plated at a 100:1 and 50:1 ratio. After an 18-h incubation at 37° C., supernatant (30 $\mu$l/well) is harvested and transferred onto Lumaplate 96 (Packard), dried, and read in a Packard Top-Count NXT $\gamma$counter. Each measurement is carried out in triplicate. Spontaneous release is determined by cpm of tumor cells incubated with medium and maximum release by cpm of tumor cells plus 1% Triton X-100 (Sigma). Specific lysis is defined as: % specific lysis=[(experimental release-spontaneous release)/(maximum release-spontaneous release)]×100. The percent ADCC is expressed as peak specific lysis postimmune subtracted by preimmune percent specific lysis. A doubling of the ADCC to >20% is considered significant.

11. Assay for Complement Dependent Cytotoxicity

Chromium release assays to assess complement-mediated cytotoxicity are performed for each patient at various time points; Dickler, M. N., Ragupathi, G., Liu, N. X., Musselli, C., Martino, D. J., Miller, V. A., Kris, M. G., Brezicka, F. T., Livingston, P. O. & Grant, S.C. (1999) Clin. Cancer Res. 5, 2773-2779. Cultured tumor cells are washed in FCS-free media two times, resuspended in 500 $\mu$l of media, and incubated with 100 $\mu$Ci $^{51}$Cr per 10 million cells for 2 h at 37° C. The cells are then shaken every 15 min for 2 h, washed 3 times in media to achieve a concentration of approximately 20,000 cells/well, and then plated in round-bottom plates. The plates contain either 50 $\mu$l cells plus 50 $\mu$l monoclonal antibody, 50 $\mu$l cells plus serum (pre- and posttherapy), or 50 $\mu$l cells plus mouse serum as a control. The plates are incubated in a cold room on a shaker for 45 min. Human complement of a 1:5 dilution (resuspended in 1 ml of ice-cold water and diluted with 3% human serum albumin) is added to each well at a volume of 100 $\mu$l. Control wells include those for maximum release of isotope in 10% Triton X-100 (Sigma) and for spontaneous release in the absence of complement with medium alone. The plates are incubated for 2 h at 37° C., centrifuged for 3 min, and then 100 $\mu$l of supernatant is removed for radioactivity counting. The percentage of specific lysis is calculated as follows: % cytotoxicity=[(experimental release-spontaneous release)/(maximum release-spontaneous release)]×100. A doubling of the CDC to >20% is considered significant.

12. In vitro Assays in Cell Lines

Lipofectamine was purchased from Invitrogen (Carlsbad, Calif.) and GeneSilencer from Gene Therapy Systems (San Diego, Calif.). Synthetic siRNA oligonucleotides were from Dharmacon (Lafayette, Colo.), Qiagen (Valencia, Calif.) or Ambion (Austin, Tex.) RNeasy 96 Kit was purchased from Qiagen (Valencia, Calif.). Apop-one homogeneous caspase-3/7 kit and CellTiter 96 AQueous One Solution Cell Proliferation Assay were both purchased from Promega (Madison, Wis.). Function blocking antibodies were purchased from Chemicon (Temecula, Calif.), Biotrend (Cologne, Germany) or Alexis Corporation (San Diego, Calif.). Cell invasion assay kits from purchased from Chemicon (Temecula, Calif.). RiboGreen RNA Quantitation Kit was purchased from Molecular probes (Eugene, Oreg.).

RNAi

RNAi was performed by using Smartpools (Dharmacon), 4—for Silencing siRNA duplexes (Qiagen) or scrambled negative control siRNA (Ambion). Transient transfections were carried out in triplicate by using either Lipofectamine 2000 from Invitrogen (Carlsbad, Calif.) or by using GeneSilencer from Gene Therapy Systems (San Diego, Calif.) in methods described below. 1 to 4 days after transfections, total RNA was isolated by using the RNeasy 96 Kit (Qiagen) according to manufacturer's instructions and expression of mRNA was quantitated by using TaqMan technology. Protein expression levels were examined by flow cytometry and apoptosis and proliferation assays were performed daily using Apop-one homogeneous caspase-3/7 kit and CellTiter 96 AQueous One Solution Cell Proliferation Assay (see protocols below).

i) RNAi Transfections—Lipofectamine 2000

Transient transfections were carried out on sub-confluent pancreatic cancer cell lines as previously described. Elbashir, S. M. et al. (2001) Nature 411: 494-498; Caplen, N. J. et al. (2001) Proc Natl Acad Sci USA 98: 9742-9747; Sharp, P. A. (2001) Genes and Development 15: 485-490. Synthetic RNA to gene of interest or scrambled negative control siRNA was transfected using lipofectamine according to manufacturer's instructions. Cells were plated in 96 well plates in antibiotic free medium. The next day, the transfection reagent and siRNA were prepared for transfection as follows: Each 0.1-1 ul of lipofectamine 2000 and 10-150 mM siRNA were resuspended 25 ul serum-free media and incubated at room temperature for 5 minutes. After incubation, the diluted siRNA and the lipofectamine 2000 were combined and incubated for 20 minutes at room temperature. The cells were then washed and the combined siRNA-Lipofectamine 2000 reagent added. After further 4 hours incubation, 50 ul serum containing medium was added to each well. 1 and 4 days after transfection, expression of mRNA was quantitated by RT-PCR using TaqMan technology and protein expression levels were examined by flow cytometry. Apoptosis and proliferation assays were performed daily using Apop-one homogeneous caspase-3/7 kit and CellTiter 96 AQueous One Solution Cell Proliferation Assay (see protocols below).

ii) RNAi Transfections—GeneSilencer

Transient transfections were carried out on sub-confluent pancreatic cancer cell lines as previously described. Elbashir, S. M. et al. (2001) Nature 411: 494-498; Caplen, N. J. et al. (2001) Proc Natl Acad Sci USA 98: 9742-9747; Sharp, P. A.

(2001) Genes and Development 15: 485-490. Synthetic RNA to gene of interest or scrambled negative control siRNA was transfected using GeneSilencer according to manufacturer's instructions. Cells were plated in 96 well plates in antibiotic free medium. The next day, the transfection reagent and the synthetic siRNA were prepared for transfection as follows: predetermined amount of Gene Silencer was diluted in serum-free media to a final volume of 20 ul per well. After resuspending 10-150 mM siRNA in 20 ul serum-free media, the reagents were combined and incubated at room temperature for 5-20 minutes. After incubation, the siRNA-Gene Silencer reagent was added to each well and incubated in a 37° C. incubator for 4 hours before an equal volume of serum containing media was added back to the cultured cells. The cells were then incubated for 1 to 4 days before mRNA, protein expression and effects on apoptosis and proliferation were examined.

Testing of Functional Blocking Antibodies

Sub-confluent pancreatic cancer cell lines are serum-staved overnight. The next day, serum-containing media is added back to the cells in the presence of 5-50 ng/ml of function blocking antibodies. After 2 or 5 days incubation at 37° C., 5% $CO_2$, antibody binding is examined by flow cytometry and apoptosis and proliferation are examined by using protocols described below.

Apoptosis

Apoptosis assay is performed by using the Apop-one homogeneous caspase-3/7 kit from Promega. Briefly, the caspase-3/7 substrate is thawed to room temperature and diluted 1:100 with buffer. The diluted substrate is then added 1:1 to cells, control or blank. The plates are then placed on a plate shaker for 30 minutes to 18 hours at 300-500 rpm. The fluorescence of each well is then measured at using an excitation wavelength of 485+/−20 nm and an emission wavelength of 530+/−25 nm.

Proliferation

Proliferation assay is performed by using the CellTiter 96 AQueous One Solution Cell Proliferation Assay kit from Promega. 20 ul of CellTiter 96 AQueous One Solution is added to 100 ul of culture medium. The plates are then incubated for 1-4 hours at 37° C. in a humidified 5% $CO_2$ incubator. After incubation, the change in absorbance is read at 490 nm. One example of the proliferation assay is MTS (3-(4,5-dimethylthiazol-2-yl)-5-(3-carboxymethanoxyphenyl)-2-(4-sulfophenyl)-2H-tetrazolium) proliferation assay.

Cell Invasion

Cell invasion assay is performed by using the 96 well cell invasion assay kit available from Chemicon. After the cell invasion chamber plates are adjusted to room temperature, 100 ul serum-free media is added to the interior of the inserts. 1-2 hours later, cell suspensions of $1 \times 10^6$ cells/ml are prepared. Media is then carefully removed from the inserts and 100 ul of prepared cells are added into the insert +/−0 to 50 ng function blocking antibodies. The cells are pre-incubated for 15 minutes at 37° C. before 150 ul of media containing 10% FBS is added to the lower chamber. The cells are then incubated for 48 hours at 37° C. After incubation, the cells from the top side of the insert are discarded and the invasion chamber plates are then placed on a new 96-well feeder tray containing 150 ul of pre-warmed cell detachment solution in the wells. The plates are incubated for 30 minutes at 37° C. and are periodically shaken. Lysis buffer/dye sulution (4 ul CyQuant Dye/300 ul 4× lysis buffer) is prepared and added to each well of dissociation buffer/cells on feeder tray. The plates are incubated for 15 minutes at room temperature before 150 ul is transferred to a new 96-well plate. Fluorescence of invading cells is then read at 480 nm excitation and 520 nm emission.

Receptor Internalization

For quantification of receptor internalization, ELISA assays are performed essentially as described by Daunt et al. Daunt, D. A., Hurtz, C., Hein, L., Kallio, J., Feng, F., and Kobilka, B. K. (1997) Mol. Pharmacol. 51, 711-720. The cell lines are plated at $6 \times 10^5$ cells per in a 24-well tissue culture dishes that have previously been coated with 0.1 mg/ml poly-L-lysine. The next day, the cells are washed once with PBS and incubated in DMEM at 37° C. for several minutes. Agonist to the cell surface target of interest is then added at a pre-determined concentration in prewarmed DMEM to the wells. The cells are then incubated for various times at 37° C. and reactions are stopped by removing the media and fixing the cells in 3.7% formaldehyde/TBS for 5 min at room temperature. The cells are then washed three times with TBS and nonspecific binding blocked with TBS containing 1% BSA for 45 min at room temperature. The first antibody is added at a pre-determined dilution in TBS/BSA for 1 hr at room temperature. Three washes with TBS followed, and cells are briefly reblocked for 15 min at room temperature. Incubation with goat anti-mouse conjugated alkaline phosphatase (Bio-Rad) diluted 1:1000 in TBS/BSA iscarried out for 1 h at room temperature. The cells are washed three times with TBS and a colorimetric alkaline phosphatase substrate isadded. When the adequate color change isreached, 100-µl samples are taken for colorimetric readings.

mRNA Expression

Expression of mRNA is quantitated by RT-PCR using Taq-Man® technology. Total RNA is isolated from cancer model cell lines using the RNEasy 96 kit (Qiagen) per manufacturer's instructions and included DNase treatment. Target transcript sequences are identified for the differentially expressed peptides by searching the BlastP database. TaqMan assays (PCR primer/probe set) specific for those transcripts are identified by searching the Celera Discovery System™ (CDS) database. The assays are designed to span exon-exon borders and do not amplify genomic DNA. The TaqMan; primers and probe sequences are as designed by Applied Biosystems (AB) as part of the Assays on Demand™ product line or by custom design through the AB Assays by Design$^{SM}$ service. RT-PCR is accomplished using AmpliTaqGold and MultiScribe reverse transcriptase in the One Step RT-PCR Master Mix reagent kit (AB) according to the manufacturers instructions. Probe and primer concentrations are 900 nM and 250 nM, respectively, in a 25 µl reaction. For each experiment, a master mix of the above components is made and aliquoted into each optical reaction well. 5 ul of total RNA is the template. Each sample is assayed in triplicate. Quantitative RT-PCR is performed using the ABI Prism® 7900HT Sequence Detection System (SDS). Cycling parameters follow: 48° for 30 min. for one cycle; 95° C. for 10 min for one cycle; 95° C. for 15 sec, 60° C. for 1 min. for 40 cycles.

The SDS software calculates the threshold cycle ($C_T$) for each reaction, and $C_T$ values are used to quantitate the relative amount of starting template in the reaction. The $C_T$ values for each set of three reactions are averaged for all subsequent calculations.

Total RNA is quantitated by using RiboGreen RNA Quantitation Kit according to manufacturer's instructions and the % mRNA expression is calculated using total RNA for normalization. % knockdown is then calculated relative to the no addition control.

Results

Figure 5:
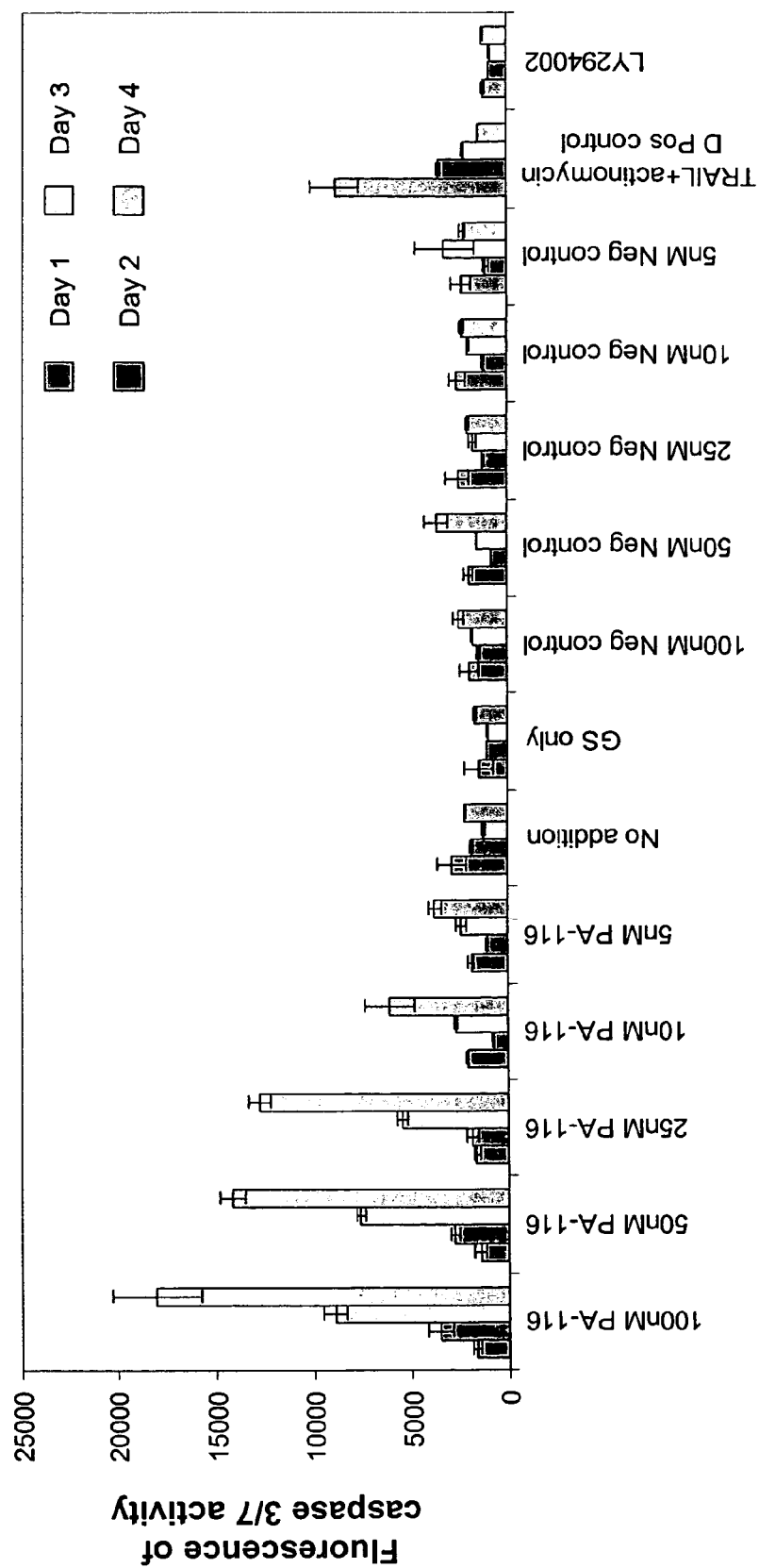
FIG. 5. Caspase 3/7 Analysis of Mucin 4 (PA-116) knockdown. Mucin siRNA induced apoptosis of ASPC-1 cells 3 days after transfection, and level of apoptosis was dose-dependent on muscin siRNA (n=3). The level of apoptosis on day 3 was similar to that given by TRAIL+ actinomycin D positive control.
Figure 6:
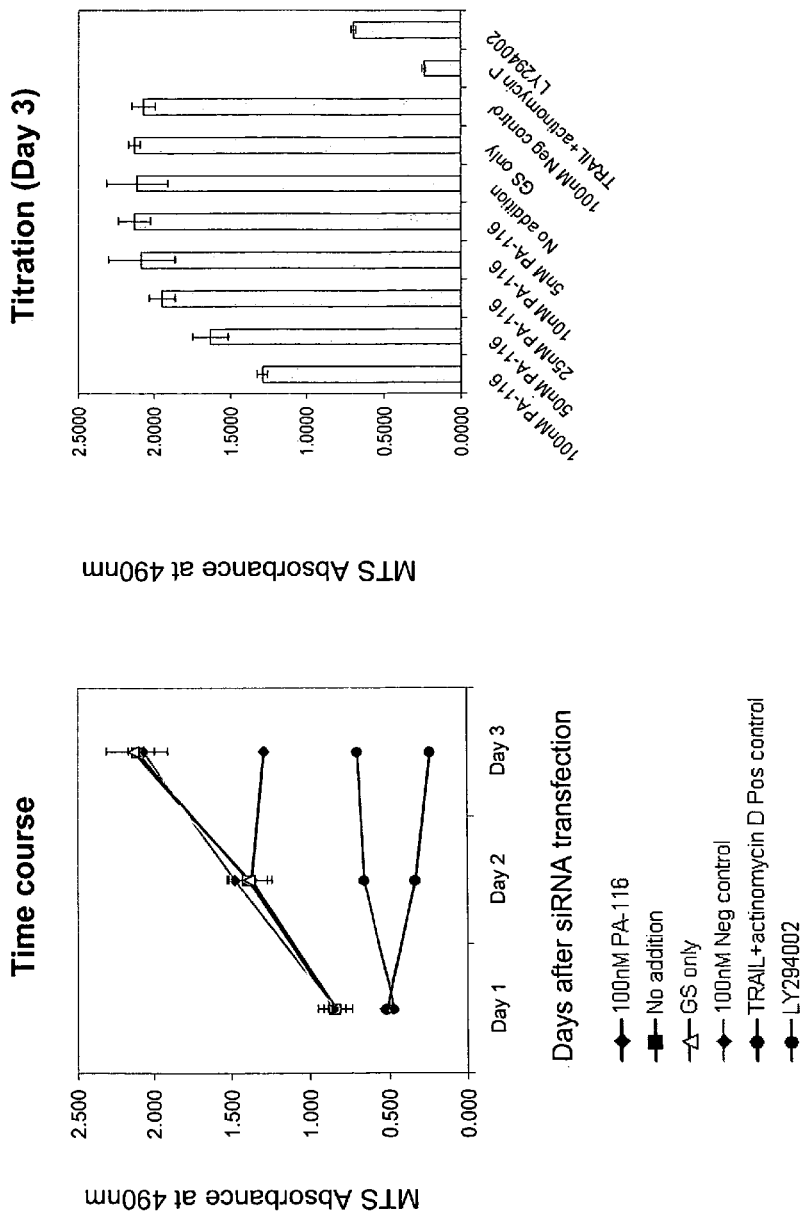
FIG. 6. Knockdown effects on MTS proliferation. Mucin 4 siRNA inhibited the proliferation of ASPC-1 cells (n=3). The level of inhibition was shown to be dose-dependent on the concentration of Mucin 4 siRNA (n=3)
Figure 7:
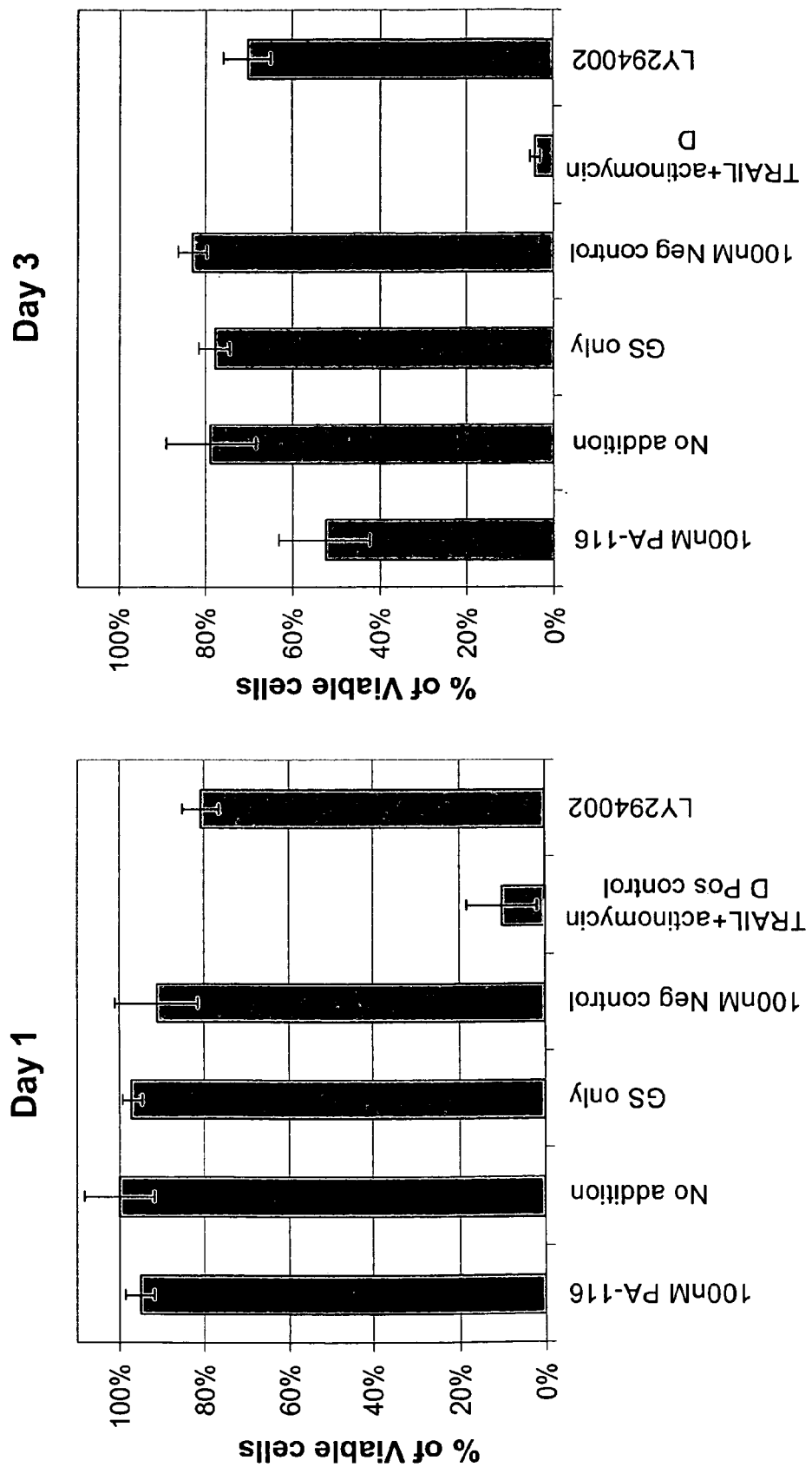
FIG. 7. Viability test on Mucin 4 (PA-116) siRNA after transfection. The result shows that Mucin siRNA can inhibit about 50% of viable ASPC-1 cells 3 days after transfection (n=2)
Figure 8:
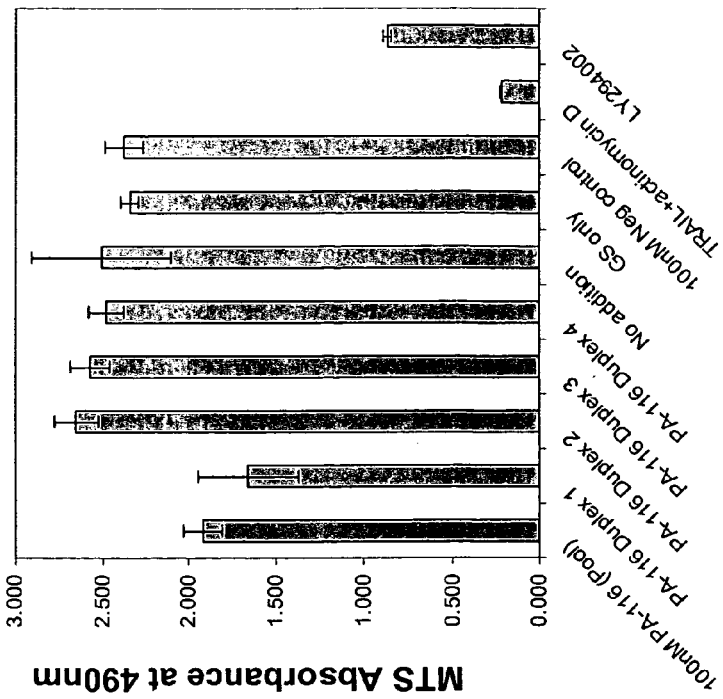
FIG. 8. Analysis of individual Mucin 4 (PA-116) siRNA vs. SMARTPool. The result shows that both SMARTPool Mucin 4 siRNA and Mucin 4 duplexI siRNA can induce an inhibition of proliferation and an increase in apoptosis 3 days after transfection FIG. 9. Morphology of ASPC-1 Pancreatic Cancer Cells with Mucin 4 SiRNA FIG. 10. Target protein expression was measured in whole cell extracts prepared from the pancreatic cell line panel. Polyclonal antibodies raised in rabbits (Green Mountain Antibodies) were used to detect Gs3786 or Retinol Dehydrogenase Type II homolog. Targets were found to be overexpressed in several cell lines relative to the reference cell line Hs766t.
Figure 8:
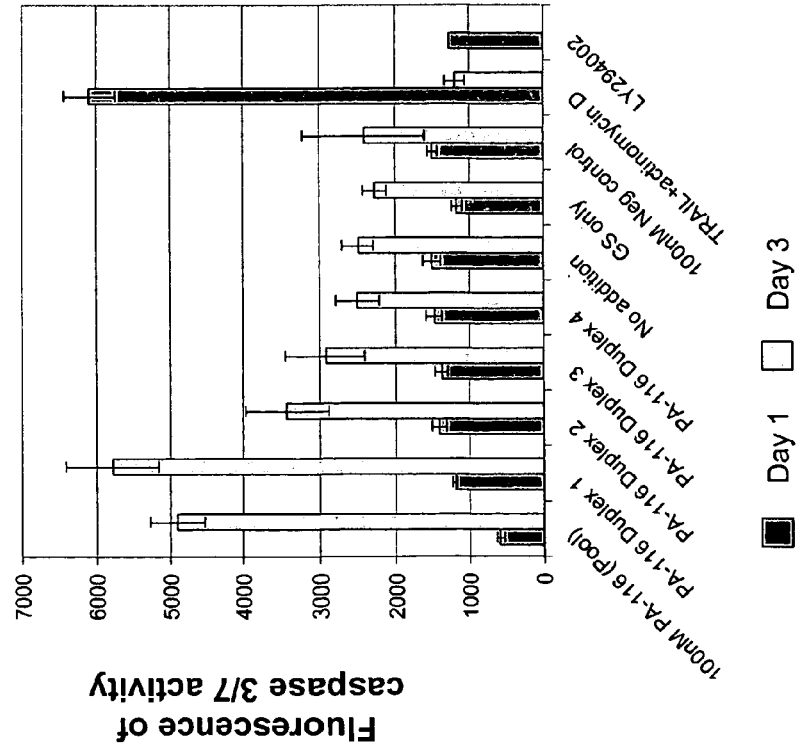
Figure 9:
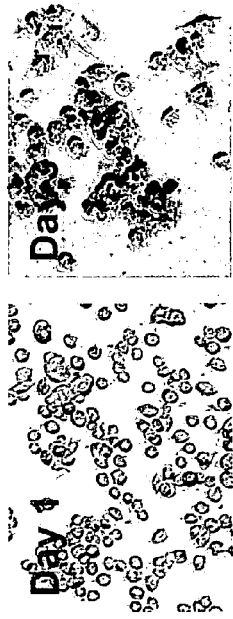
Figure 9:
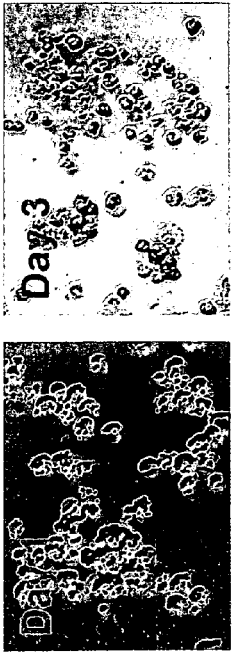
Figure 9:
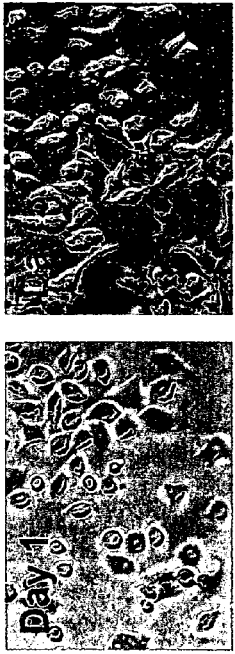
Figure 9:
Figure 9:
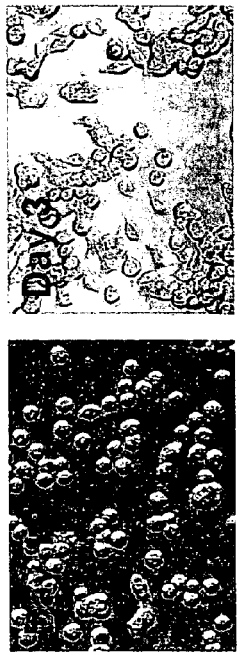

The assay was performed on analysis of Mucin 4 knowdown. Mucin 4 siRNA induced apoptosis of ASPC-1 cells 3 days after transfection, and level of apoptosis was dose-dependent on muscin siRNA (n=3). The level of apoptosis on day 3 was similar to that given by TRAIL+ actinomycin D positive control (FIG. 5). Moreover, FIG. 6 also shows that Mucin 4 siRNA inhibited the proliferation of ASPC-1 cells (n=3). FIG. 7 shows that the level of inhibition was dose-dependent on the concentration of Mucin 4 siRNA (n=3). The result shows that Mucin 4 siRNA can inhibit about 50% of viable ASPC-1 cells 3 days after transfection (n=2). Both SMARTPool Mucin 4 siRNA and Mucin 4 duplex1 siRNA can induce an inhibition of proliferation and an increase in apoptosis 3 days after transfection (FIG. 8). Additional assays were also performed on other targets: Apoptosis occurred when $Na^+/K^+$ transporting ATPase beta-3 chain (PA-088), GS3786(PA-078), CD49c(PA-009), siRNA were administrated in Cacaspase 3/7 analysis in ASPC-1 cell line. Apoptosis occurred when $Na^+/K^+$ transporting ATPase beta-3 chain, GS3786, and Celera protein RNAi were administrated in Cacaspase 3/7 analysis in BXPC-3 cell line. Specifically, $Na^+/K^+$ transporting ATPase beta-3 chain increased apoptosis of ASPC-1 pancreatic cancer cells in a dose-dependent manner and can decrease proliferation of ASPC-1 pancreatic cancer cells. GS3786 siRNA increased apoptosis of ASPC-1 pancreatic cancer cells in a dose-dependent manner. It increased apoptosis of BXPC-3 pancreatic cancer cells and decreased proliferation of ASPC-1 and BXPC-3 pancreatic cancer cells. CD49c siRNA increased apoptosis of BXPC-3 pancreatic cancer cells in a dose-dependent manner and decreased proliferation of BXPC-3 pancreatic cancer cells in a dose-dependent manner. (FIG. 11 and FIG. 12]

13. In Vivo Studies by Using Antibodies

Treatment of Pancreatic Cancer Cells With Monoclonal Antibodies.

Pancreatic cancer cells are seeded at a density of $4 \times 10^4$ cells per well in 96-well microtiter plates and allowed to adhere for 2 hours. The cells are then treated with different concentrations of anti-PCAT monoclonal antibody (Mab) or irrelevant isotype matched (anti-rHuIFN-. gamma. Mab) at 0.05, 0.5 or 5.0 mug/ml. After a 72 hour incubation, the cell monolayers are stained with crystal violet dye for determination of relative percent viability (RPV) compared to control (untreated) cells. Each treatment group consists of replicates. Cell growth inhibition is monitored.

Treatment of NIH 3T3 Cells Overexpression PCAT Protein with Monoclonal Antibodies.

NIH 3T3 expressing PCAT protein are treated with different concentrations of anti-PCAT MAbs. Cell growth inhibition is monitored.

In Vivo Treatment of NIH 3T3 Cells Overexpressing PCAT with Anti-PCAT Monoclonal Antibodies.

NIH 3T3 cells transfected with etiher a PCAT expression plasmidor the neo-DHFR vector are injected into nu/lnu (athymic) mice subcutaneously at a dose of $10^6$ cells in 0.1 ml of phosphate-buffered saline. On days 0, 1, 5 and every 4 days thereafter, 100 mug (0.1 ml in PBS) of either an irrelevant or anti-PCAT monoclonal antibody of the IG2A subclass is injected intraperitoneally. Tumor occurrence and size are monitored for 1 month period of treatment.

All publications and patents mentioned in the above specification are herein incorporated by reference. Various modifications and variations of the described method and system of the invention will be apparent to those skilled in the art without departing from the scope and spirit of the invention. Although the invention has been described in connection with specific preferred embodiments, it should be understood that the invention as claimed should not be unduly limited to such specific embodiments. Indeed, various modifications of the above-described modes for carrying out the invention, which are obvious to those skilled in the field of molecular biology or related fields, are intended to be within the scope of the following claims.

---

SEQUENCE LISTING (875 sequences)

SEQ ID NO: 1 - protein, 295 aa, Homo sapiens
METPAWPRVPRPETAVARTLLLGWVFAQVAGASGTTNTVAAYNLTWKSTNFKTILEWEPKPVNQVYTVQISTKSGDWKSKCFYTTDTECDLTDEIVKDVKQTYLARVFSYPAGNVESTGSAGEPLYENSPEFTPYLETNLGQPTIQSFEQVGTKVNVTVEDERTLVRRNNTFLSLRDVFGKDLIYTLYYWKSSSSGKKTAKTNTNEFLIDVDKGENYCFSVQAVIPSRTVNRKSTDSPVECMGQEKGEFREIFYIIGAVVFVVIILVIILAISLHKCRKAGVGQSWKENSPLNVS

SEQ ID NO: 2 - protein, 314 aa, Homo sapiens
MAPPQVLAFGLLLAAATATFAAAQEECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 3 - protein, 390 aa, Homo sapiens
MAPPQVLAFGLLLAAATATFAAAQEGEARIGAELWSWAGLGGSGPRPSAPETGIIGRGPRGRAFQRGDRTVRPCSGSGPPRGRKRRGPSRGAASLRSFARLECVCENYKLAVNCFVNNNRQCQCTSVGAQNTVICSKLAAKCLVMKAEMNGSKLGRRAKPEGALQNNDGLYDPDCDESGLFKAKQCNGTSMCWCVNTAGVRRTDKDTEITCSERVRTYWIIIELKHKAREKPYDSKSLRTALQKEITTRYQLDPKFITSILYENNVITIDLVQNSSQKTQNDVDIADVAYYFEKDVKGESLFHSKKMDLTVNGEQLDLDPGQTLIYYVDEKAPEFSMQGLKAGVIAVIVVVVIAVVAGIVVLVISRKKRMAKYEKAEIKEMGEMHRELNA

SEQ ID NO: 4 - protein, 314 aa, Homo sapiens [sequence omitted]

SEQ ID NO: 5 - protein, 516 aa, Homo sapiens
MEPAVSLAVCALLFLLWVRLKGLEFVLIHQRWVFVCLFLLPLSLIFDIYYYVRAWVVFKLSSAPRLHEQRVRDIQKQVREWKEQGSKTFMCTGRPGWLTVSLRVGKYKKTHKNIMINLMDILEVDTKKQIVRVEPLVTMGQVTALLTSIGWTLPVLPELDDLTVGGLIMGTGIESSSHKYGLFQHICTAYELVLADGSFVRCTPSENSDLFYAVPWSCGTLGFLVAAEIRIIPAKKYVKLRFEPVRGLEAICAKFTHESQRQENHFVEGLLYSLDEAVIMTGVMTDEAEPSKLNSIGNYYKPWFFKHVENYLKTNREGLEYIPLRHYYHRHTRSIFWELQDIIPFGNNPIFRYLFGWMVPPKISLLKLTQGETLRKLYEQHHVVQDMLVPMKCLQQALHTFQNDIHVYPIWLCPFILPSQPGLVHPKGNEAELYIDIGAYGEPRVKHFEARSCMRQLEKFVRSVHGFQMLYADCYMNREEFWEMFDGSLYHKLREKLGCQDAFPEVYDKICKAARH

SEQ ID NO: 6 - protein, 219 aa, Homo sapiens
MNYNIIFKIIKHFKNYTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 7 - protein, 819 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTPGVQWCDISSLQPLTSRFQQFSCLSLPSTWDYRVKILFIRVP

SEQ ID NO: 8 - protein, 825 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTSLSVAQPGVQWCDISSLQPLTSRFQQFSCLSLPSTWDYRVKILFIRVP

SEQ ID NO: 9 - protein, 798 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTGENPIYKSAVTTVVNPKYEGK

SEQ ID NO: 10 - protein, 801 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTQENPIYKSPINNFKNPNYGRKAGL

SEQ ID NO: 11 - protein, 789 aa, Homo sapiens
MNLQPIFWIGLISSVCCVFAQTDENRCLKANAKSCGECIQAGPNCGWCTNSTFLQEGMPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKGEKKDTCTQECSYFNITKVESRDKLPQPVQPDPVSHCKEKDVDDCWFYFTYSVNGNNEVMVHVVENPECPTGPDIIPIVAGVVAGIVLIGLALLLIWKLLMIIHDRREFAKFEKEKMNAKWDTVSYKTSKKQSGL

SEQ ID NO: 12 - protein, 682 aa, Homo sapiens
MPTSARCDDLEALKKKGCPPDDIENPRGSKDIKKNKNVTNRSKGTAEKLKPEDITQIQPQQLVLRLRSGEPQTFTLKFKRAEDYPIDLYYLMDLSYSMKDDLENVKSLGTDLMNEMRRITSDFRIGFGSFVEKTVMPYISTTPAKLRNPCTSEQNCTSPFSYKNVLSLTNKGEVFNELVGKQRISGNLDSPEGGFDAIMQVAVCGSLIGWRNVTRLLVFSTDAGFHFAGDGKLGGIVLPNDGQCHLENNMYTMSHYYDYPSIAHLVQKLSENNIQTIFAVTEEFQPVYKELKNLIPKSAVGTLSANSSNVIQLIIDAYNSLSSEVILENGKLSEGVTISYKSYCKNGVNGTGENGRKCSNISIGDEVQFEISITSNKCPKKDSDSFKIRPLGFTEEVEVILQYICECECQSEGIPESPKCHEGNGTFECGACRCNEGRVGRHCECSTDEVNSEDMDAYCRKENSSEICSNNGECVCGQCVCRKRDNTNEIYSGKFCECDNFNCDRSNGLICGGNGVCKCRVCECNPNYTGSACDCSLDTSTCEASNGQICNGRGICECGVCKCTDPKFQGQTCEMCQTCLGVCAEHKECVQCRAFNKVESRDKLPQPVQPDPVSHCKEKDVDDCWFYFTYSVNGNNEVMVHVVENPVSHWSRHHSNCSWCGCWNCSYWPCITADMEAFNDNS

SEQ ID NO: 13 - protein, 798 aa, Homo sapiens [sequence omitted]

SEQ ID NO: 14 - protein, 198 aa, Homo sapiens
MVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 15 - protein, 265 aa, Homo sapiens
MLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 16 - protein, 231 aa, Homo sapiens
MLSEGDILFSSLLSSPSLFWPPGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKE

SEQ ID NO: 17 - protein, 222 aa, Homo sapiens
MWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 18 - protein, 279 aa, Homo sapiens
MTKNEKKSLNQSLAEWKLFIYNPTTGEFLGRTAKSWGLILLFYLVFYGFLAALFSFTMWVMLQTLNDEVPKYRDQIPSPGLMVFPKPVTALEYTFSRSDPTSYAGYIEDLKKFLKPYTLEEQKNLTVCPDGALFEQKGPVYVACQFPISLLQACSGMNDPDFGYSQGNPCILVKMNRIIGLKPEGVPRIDCVSKNEDIPNVAVYPHNGMIDLKYFPYYGKKLHVGYLQPLVAVQVSFAPNNTGKEVTVECKIDGSANLKSQDDRDKFLGRVMFKITARA

SEQ ID NO: 19 - protein, 921 aa, Homo sapiens
MQWDVAQRSGKPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHSSASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 20 - protein, 563 aa, Homo sapiens
MPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 21 - protein, 1176 aa, Homo sapiens [sequence omitted]

SEQ ID NO: 22 - protein, 357 aa, Homo sapiens
MATTVPDGCRNGLKSKYYRLCDKAEAWGIVLETVATAGVVTSVAFMLTLPILVCKVQDSNRRKMLPTQFLFLLGVLGIFGLTFAFIIGLDGSTGPTRFFLFGILFSICFSCLLAHAVSLTKLVRGRKPLSLLVILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGFEETGDTLYAPYSTHFQLQNQPPQKEFSIPRAHAWPSPYKDYEVKKEGS

SEQ ID NO: 23 - protein, 357 aa, Homo sapiens [sequence omitted]

SEQ ID NO: 24 - protein, 365 aa, Homo sapiens
MASTESSLLRSLGLSPGPGSSEVELDCWFDEDFKFILLPVSYAVVFVLGLGLNAPTLWLFIFRLRPWDATATYMFHLALSDTLYVLSLPTLIYYYAAHNHWPFGTEICKFVRFLFYWNLYCSVLFLTCISVHRYLGICHPLRALRWGRPRLAGLLCLAVWLVVAGCLVPNLFFVTTSNKGTTVLCHDTTRPEEFDHYVHFSSAVMGLLFGVPCLVTLVCYGLMARRLYQPLPGSAQSSSRLRSLRTIAVVLTVFAVCFVPFHITRTIYYLARLLEADCRVLNIVNVVYKVTRPLASANSCLDPVLYLLTGDKYRRQLRQLCGGGKPQPRTAASSLALVSLPEDSSCRWAATPQDSSCSTPRADRL

SEQ ID NO: 25 - protein, 499 aa, Homo sapiens
RPQGPAVESERGFPCRASPARSPLAGQVTHYKQYPPNTSKVYSYFECREKKTENSKLRKVKYEETVFYGLQYILNKYLKGKVVTKEKIQEAKDVYKEHFQDDVVNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALNKKYYGTKDPVPGYSVPAAEHSTITAWGKDHEKDAFEHIVTQFSSVPVSVVSNSYDIYNACEKIWGEDLRHLIVSRSTQAPLIIRPDSGNPLDTVLKVLEILGKKFPVTENSKGYKLLPPYLRVIQGDGVDINTLQEIVEGMKQKMWSIENIAFGSGGGLLQKLTRDLLNCSFKCSYVVTNGLGINVFKDPVADPNKRSKKGRLSLHRTPAGNFVTLEEGKGDLEEYGQDLLHTVFKNGKVTKSYSFDEIRKNAQLNIELEAAHH

SEQ ID NO: 26 - protein, 491 aa, Homo sapiens [sequence omitted]

SEQ ID NO: 27 - protein, 299 aa, Homo sapiens
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 28 - protein, 262 aa, Homo sapiens
MEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSSVCADNHPDQLRGHLAVHIPSWLVVFPDWIHDFPDCSLHKLLHSDLQQERGLPKERPPEGPPEWVHGCCEWTHQQLFTPGKQCEAKEAAEGLKSKN

SEQ ID NO: 29 - protein, 301 aa, Homo sapiens
FQMEHFDASLSTYFKALLGPRDTRVKGWFLLDNYIPTFICSVIYLLIVWLGPKYMRNKQPFSCRGILVVYNLGLTLLSLYMFCELVTGVWEGKYNFFCQGTRTAGESDMKIIRVLWWYYFSKLIEFMDTFFFILRKNNHQITVLHVYHHASMLNIWWFVMNWVPCGHSYFGATLNSFIHVLMYSYYGLSSVPSMRPYLWWKKYITQGQLLQFVLTIIQTSCGVIWPCTFPLGWLYFQIGYMISLIALFTNFYIQTYNKKGASRRKDHLKDHQNGSMAAVNGHTNSFSPLENNVKPRKLRKD

SEQ ID NO: 30 - protein, 364 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 31 - protein, 368 aa, Homo sapiens
MPYQYPALTPEQKKELSDIAHRIVAPGKGILAADESTGSIAKRLQSIGTENTEENRRFYRQLLLTADDRVNPCIGGVILFHETLYQKADDGRPFPQVIKSKGGVVGIKVDKGVVPLAGTNGETTTQGLDGLSERCAQYKKDGADFAKWRCVLKIGEHTPSALAIMENANVLARYASICQQVGLQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 32 - protein, 252 aa, Homo sapiens
RPRPHGRTLGRAAAGRAQRLRHRCAWWPDSKWDRRTRSLACQGKLMENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRVSLPSSPVPASPASSSGADQRLPSQSLSSKQKGHTWALETDSASATVLGQDL

SEQ ID NO: 33 - protein, 254 aa, Homo sapiens
RADPGPTGGHSAGQPRAERSRLRHRCAWWPDSKWDRRTRSLACQGKLMENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRVSLPSSPVPASPASSSGADQRLPSQSLSSKQKGHTWALETDSASATVLGQDL

SEQ ID NO: 34 - protein, 263 aa, Homo sapiens
GTRVGIKVDKGVVPLAGTNGETTTQGLDGLSERCAQYKKDGADFAKWRCVLKIGEHTPSALAIMENANVLARYASICQQNGIVPIVEPEILPDGDHDLKRCQYVTEKVLAAVYKALSDHHIYLEGTLLKPNMVTPGHACTQKFSHEEIAMATVTALRRTVPPAVTGITFLSGGQSEEEASINLNAINKCPLLKPWALTFSYGRALQASALKAWGGKKENLKAAQEEYVKRALANSLACQGKYTPSGQAGAAASESLFVSNHAY

SEQ ID NO: 35 - protein, 227 aa, Homo sapiens
MRVAGAAKLVVAVAVFLLTFYVISQVFEIKMDASLGNLFARSALDTAARSTKPPRYKCGISKACPEKHFAFKMASGAANVVGPKICLEDNVLMSGVKNNVGRGINVALANGKTGEVLDTKYFDMWGGDVAPFIEFLKAIQDGTIVLMGTYDDGATKLNDEARRLIADLGSTSITNLGFRDNWVFCGGKGIKTKSPFEQHIKNNKDTNKYEGWPEVVEMEGCIPQKQD

SEQ ID NO: 36 - protein, 440 aa, Homo sapiens
MSSCRGQKVAGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASAKIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 37 - protein, 430 aa, Homo sapiens
GGLRVVSPFPLCQPAGEPSRGKMRSSCVLLTALVALATYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASAKIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 38 - protein, 154 aa, Homo sapiens
MAQVDSGLELSWGSLFAAAAAAATAVLGARSPAMGNTLQSFRDHTFLYEKLYTGKPNLVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 39 - protein, 140 aa, Homo sapiens
MSRFLNVLRSWLVMVSIIAMGNTLQSFRDHTFLYEKLYTGKPNLVNGLQARTFGIWTLLSSVIRCLCAIDIHNKTLYHITLWTFLLALGHFLSELFVYGTAAPTIGVLAPLMVASFSILGMLVGLRYLEVEPVSRQKKRN

SEQ ID NO: 40 - protein, 399 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 41 - protein, 183 aa, Homo sapiens
MAERRRHKKRIQEVGEPSKEEKAVAKYLRFNCPTKSTNMMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNE

SEQ ID NO: 42 - protein, 361 aa, Homo sapiens
MMGHRVDYFIASKAVDCLLDSKWAKAKKGEEALFTTRESVVDYCNRLLKKQFFHRALKVMKMKYDKDIKKEKDKGKAESGKEEDKKSKKENIKDEKTKKEKEKKKDGEKEESKKEETPGTPKKKETKKKFKLEPHDDQVFLDGNEVYVWIYDPVHFKTFVMGLILVIAVIAATLFPLWPAEMRVGVYYLSVGAGCFVASILLLAVARCILFLIIWLITGGRHHFWFLPNLTADVGFIDSFRPLYTHEYKGPKADLKKDEKSETKKQQKSDSEEKSDSEKKEDEEGKVGPGNHGTEGSGGERHSDTDSDRREDDRSQHSSGNGNDFEMITKEELEQQTDGDCEEDEEEENDGETPKSSHEKS

SEQ ID NO: 43 - protein, 702 aa, Homo sapiens
MESPSAPPHRWCIPWQRLLLTASLLTFWNPPTTAKLTIESTPFNVAEGKEVLLLVHNLPQHLFGYSWYKGERVDGNRQIIGYVIGTQQATPGPAYSGREIIYPNASLLIQNIIQNDTGFYTLHVIKSDLVNEEATGQFRVYPELPKPSISSNNSKPVEDKDAVAFTCEPETQDATYLWWVNNQSLPVSPRLQLSNGNRTLTLFNVTRNDTASYKCETQNPVSARRSDSVILNVLYGPDAPTISPLNTSYRSGENLNLSCHAASNPPAQYSWFVNGTFQQSTQELFIPNITVNNSGSYTCQAHNSDTGLNRTTVTTITVYAEPPKPFITSNNSNPVEDEDAVALTCEPEIQNTTYLWWVNNQSLPVSPRLQLSNDNRTLTLLSVTRNDVGPYECGIQNELSVDHSDPVILNVLYGPDDPTISPSYTYYRPGVNLSLSCHAASNPPAQYSWLIDGNIQQHTQELFISNITEKNSGLYTCQANNSASGHSRTTVKTITVSAELPKPSISSNNSKPVEDKDAVAFTCEPEAQNTTYLWWVNGQSLPVSPRLQLSNGNRTLTLFNVTRNDARAYVCGIQNSVSANRSDPVTLDVLYGPDTPIISPPDSSYLSGANLNLSCHSASNPSPQYSWRINGIPQQHTQVLFIAKITPNNNGTYACFVSNLATGRNNSIVKSITVSASGTSPGLSAGATVGIMIGVLVGVALI

SEQ ID NO: 44 - protein, 319 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 45 - protein, 163 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPTGHESFWCARLMH

SEQ ID NO: 46 - protein, 279 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPLVKKAQGRVINVSSVGGRLAIVGGGYTPSKYAVEGFNDSLRRDMKAFGVHVSCIERLDKLKGNKSYVNMDLSPVVECMDHALTSLFPKTHYAAGKDAKIFWIPLSHMPAALQDFLLLKQKAELANPKAV

SEQ ID NO: 47 - protein, 323 aa, Homo sapiens
MLFWVLGLLILCGFLWTRKGKLKIEDITDKYIFITGCDSGFGNLAARTFDKKGFHVIAACLTESGSTALKAETSERLRTVLLDVTDPENVKRTAQWVKNQVGEKGLWGLINNAGVPGVLAPTDWLTLEDYREPIEVNLFGLISVTLNMLPRPQEDQPGQGGTTLPSPCTAGKLPSVGGGYTPSKYAVEGFNDSLRRDMKAFGVHVSCIEPGLFKTNLADPVKVIEKKLAIWEQLSPDIKQQYGEGYIEKSLDKLKGNKSYVNMDLSPVVECMDHALTSLFPKTHYAAGKDAKIFWIPLSHMPAALQDFLLLKQKAELANPKAV

SEQ ID NO: 48 - protein, 536 aa, Homo sapiens
MQNLNKLQTPEEKFDFLFKKYAELLDEHRTEQKKLKLLQKKQVQIQKEKDQLQGEHSRAILARSKLESLCRELQRHNKTLKEEALQRAREEEEKRKEITSHFQSTLTDIQGQIEQQSERNMKLCQENTELAEKLKSIIDQYELREEHLDKIFKHRELQQKLVDAKLEQAQEMMKEAEERHKREKEYLLNQAAEWKLQAKVLKEQETVLQAQLTLYSGRFEEFQSTLTKSNEVFATFKQEMDKTTKKMKKLEKDTATWKARFENCNKALLDMIEEKALRAKEYECFVMKIGRLENLCRALQEERNELHKKIRDAEISEKDDQSQHNSDEEPESNVSVDQEIDAEEVNSVQTAVKNLATAFMIIHHPESTPHQSKETQPEIGSSQESADAALKEPEQPPLIPSRDSESPLPPLTPQAEAEGGSDAEPPSKASNSPAGLGAETQCEGLPVGAQADQASWKPEAEASGQAPQAPTEASLQKMEADVPAPACAAEEHVAAMVPACEPSRQPPRAAAEELPVGASAGPQPRNVADTNLEGVD

SEQ ID NO: 49 - protein, 505 aa, Homo sapiens
QKKLKLLQKKQVQIQKEKDQLQGEHSRAILARSKLESLCRELQRHNKTLKEEALQRAREEEEKRKEITSHFQSTLTDIQGQIEQQSERNMELCQENTELAEKLKSIIDQYELREEHLDKIFKHRELQQKLVDAKLEQAQEMMKEAEERHKREKEYLLNQAAEWKLQAKMLKEQETVLQAQLTLYSGRFEEFQSTLTKSNEVFATFKQEMDKTTKKMKKLEKDTATWKARFENCNKALLDMIEEKALRAKEYECFVMKIGRLENLCRALQEERNELHKKIRDAEISEKDDQSQHNSDEEPESNVSVDQEIDAEEVNSVQTAVKNLATAFMIIHHPESTPHQSKETQPEIGSSQESADAALKEPEQPPLIPSRDSESPLPPLTPQAEAEGGSDAEPPSKASNSPAGLGAETQCEGLPVGAQADQPSWKPEAEASGQAPQAPTEASLQKMEADVPAPACAAEEHVAAMVPACEPSRQPPRAAAEELPVGASAGPQPRNVADTNLEGVD

SEQ ID NO: 50 - protein, 2951 aa, Homo sapiens [sequence omitted]

SEQ ID NO: 51 - protein, 5065 aa, Homo sapiens
MAATLGAGTPPRPQARSIAGVYVEASGQAQSVYAAMEQGLLPAGLGQALLEAQAATGGLVDLARGQLLPVSKALQQGLVGLELKEKLLAAERATTGYPDPYGGEKLALFQAIGKEVVDRALGQSWLEVQLATGGLVDPAQGVLVAPEPACHQGLLDRETWHKLSELEPGTGDLRFLNPNTLERLTYHQLLERCVRAPGSGLALLPLKITFRSMGGAVSAAELLEVGILDEQAVQGLREGRLAAVDVSARAEVRRYLEGTGSVAGVVLLPEGHKKSFFQAATEHLLPMGTALPLLEAQAATHTLVDPITGQRLWVDEAVRAGLVSPELHEQLLVAEQAVTGHHDPFSGSQIPLFQAMKKGLVDRPLALRLLDAQLATGGLVCPARRLRLPLEAALRCGCLDEDTQRQLSQAGSFSDGTHGGLRYEQLLALCVTDPETGLAFLPLSGGPRGGEPQGPPFIKYSTRQALSTATATVSVGKFRGRPVSLWELLFSEAISSEQRAMLAQQYQEGTLSVEKLAAELSATLEQAAATARVTFSGLRDTVTPGELLKAEIIDQDLYERLEHGQATAKDVGSLASAQRYLQGTGCIAGLLLPGSQERLSIYEARCKGLLRPGTALILLEAQAATGFIIDPKANKGHSVEEALRAAVIGPDVFAKLLSAERAVTGYTDPYTGQQISLFQAMQKGLIVREHGIRLLEAQIATGGVIDPVHSHRVPVDVAYRRGYFDQMLNLILLDPSDDTKGFFDPNTHENLTYLQLLERCVRDPETGLYLLPLSSTQSPLVDSATQQAFQNLLLSVKYGRFQGQRVSAWELINSEYFSEGRRRQLLRRYRQREVTLGQVAKLLEAETQRQADIMLPALRSRVTVHQLLEAGIIDQQLLDQVLAGTISPEALLLMDGVRRYLCGLGAVGGVRLLPSGQRLSLYQAMRQKLLGPRVALALLEAQAATGTIMDPHSPESLSVDEAVRRGVVGPELYGRLKRAEGAIAGFRDPFSGKQVSVFQAMKKGLIPWEQAARLLEAQVATGGIIDPTSHHHLPMPVAIQRGYVDQEMETALSSSSETFPTPDGQGRTSYAQLLEECPRDETSGLHLLPLPESAPALPTEEQVQRSLQAVPGAKDGTSLWDLLSSCHFTEEQRRGLLEDVQEGRTTVPQLLASVQRWVQETKLLAQARVMVPGPRGEVPAVWLLDAGIITQETLEALAQGTQSPAQVAEQPAVKACLWGTGCVAGVLLQPSGAKASIAQAVRDGLLPTGLGQRLLEAQVASGFLVDPLNNQRLSVEDAVKVGLVGRELSEQLGQAERAAAGYPDPYSRASLSLWQAMEKGLVPQNEGLPLLQVQLATGGVVDPVHGVHLPQAAACRLGLLDTQTSQVLTAVDKDNKFFFDPSARDQVTYQQLRERCVCDSETGLLLLPLPSDTVLEVDDHTAVALRAMKVPVSTGRFKGCSVSLWDLLLSEYVGADKRRELVALCRSGRAAALRQVVSAVTALVEAAERQPLQATFRGLRKQVSARDLFRAQLISRKTLDELSQGTTTVKEVAEMDSVKRSLEGGNFIAGVLIQGTQERMSIPEALRRHILRPGTALVLLEAQAATGFIIDPAENRKLTVEEAFKAGMFGKETYVKLLSAERAVTGYTDPYTGQQISLFQAMQKDLIVREHGIRLLEAQIATGGIIDPVHSHRVPVDVAYRCGYFDEEMNRILADPSDDTKGFFDPNTHENLTYLQLLERCVEDPETGLYLLQIIKKGENYVYINEATRHVLQSRTAKMRVGRFADQVVSFWDLLSSPYFTEDRKRELIQEYGAQSGGLEKLLEIITTTIEETETQNQGIKVAAIRGEVTAADLFNSRVIDQKTLHTLRVGRTGGQALSTLECVKPYLEGSDCIAGVTVPSTREVMSLHEASRKELIPAAFATWLLEAQAATGFLLDPCTRQKLSVDEAVDVGLVNEELRERLLKAERAATGYRDPATGDTIPLFQAMQKQLIEKAEALRLLEVQVATGGVIDPQHHHRLPLETAYRRGCLHKDIYALISDQKHMRKRFVDPNTQEKVSYRELQERCRPQEDTGWVLFPVNKAARDSEHIDDETRRALEAEQVEITVGRFRGQKPTLWALLNSEYVTEEKKLQLVRMYRTHTRRALQTVAQLILELIEKQETSNKHLWFQGIRRQITASELLSSAIITEEMLQDLETGRSTTQELMEDDRVKRYLEGTSCIAGVLVPAKDQPGRQEKMSIYQAMWKGVLRPGTALVLLEAQAATGFVIDPVRNLRLSVEEPVPAGVVGSEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDARRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRASTLTVEELGATLTSLLAQAQAQARAEAEAGSPRPDPREALRAATMEVKVGRLRGRAVPVWDVLASGYVSRAAREELLAEFGSGTLDLPALTRRLTAIIEEAEEAPGARPQLQDAWRGPREPGPAGRGDGDSGRSQREGQGEGETQEAAAATAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYVQLLRRCVPDPDTGLYMLQLAGRGSAVHQLSEELRCALRDARVTPGSGALQGQSVSVWELLFYREVSEDRRQDLLSRYRAGTLTVEELGATLTSLLAQAQAQARAEAEAGSPRPDPREALRAATMEVKVGRLRGRAVPVWDVLASGYVSGAAREELLAEFGSGTLDLPALTRRLTAIIEEAEEAPGARPQLQDAWRGPREPGPAGRGDGDSGRSQREGQGEGETQEAAAAAAAARRQEQTLRDATMEVQRGQFQGRPVSVWDVLFSSYLSEARRDELLAQHAAGALGLPDLVAVLTRVIEETEERLSKVSFRGLRRQVSASELHTSGILGPETLRDLAQGTKTLQEVTEMDSVKRYLEGTSCIAGVLVPAKDQPGRQEKMSIYQAMWKGVLRPGTALVLLEAQAATGFVIDPVRNLRLSVEEAVAAGVVGGEIQEKLLSAERAVTGYTDPYTGQQISLFQAMQKDLIVREHGIRLLEAQIATGGVIDPVHSHRVPVDVAYRRGYFDEEMNRVLADPSDDTKGFFDPNTHENLTYLQLLQRATLDPETGLLFLSLSLQ

SEQ ID NO: 52 - protein, 1179 aa, Homo sapiens
MAACGRVRRMFRLSAALHLLLLFAAGAEKLPGQGVHSQGQGPGANFVSFVGQAGGGGPAGQQLPQLPQSSQLQQQQQQQQQQQQPQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 53 - protein, 1179 aa, Homo sapiens
MAACGRVRRMFRLSAALHLLLLFAAGAEKLPGHGVHSQGQGPGANFVSFVGQAGGGGPAGQQLPQLLQSSQLQQQQQQQQQQQQLQPPQPPFPAGGPPARRGGAGAGGGWKLAEEESCREDVTRVCPKHTWSNNLAVLECLQDVREPENEISSDCNHLLWNYKLNLTTDPKFESVAREVCKSTITEIKECADEPVGKGYMVSCLVDHRGNITEYQCHQYITKMTAIIFSDYRLICGFMDDCKNDINILKCGSIRLGEKDAHSQGEVVSCLEKGLVKEAEEREPKIQVSELCKKAILRVAELSSDDFHLDRHLYFACRDDRERFCENTQAGEGRVYKCLFNHKFEESMSEKCREALTTRQKLIAQDYKVSYSLAKSCKSDLKKYRCNVENLPRSREARLSYLLMCLESAVHRGRQVSSECQGEMLDYRRMLMEDFSLSPEIILSCRGEIEHHCSGLHRKGRTLHCLMKVVRGEKGNLGMNCQQALQTLIQETDPGADYRIDRALNEACESVIQTACKHIRSGDPMILSCLMEHLYTEKMVEDCEHRLLELQYFISRDWKLDPVLYRKCQGDASRLCHTHGWNETSEFMPQGAVFSCLYRHAYRTEEQGRRLSRECRAEVQRILHQRAMDVKLDPALQDKCLIDLGKWCSEKTETGQELECLQDHLDDLVVECRDIVGNLTELESEDIQIEALLMRACEPIIQNFCHDVADNQIDSGDLMECLIQNKHQKDMNEKCAIGVTHFQLVQMKDFRFSYKFKMACKEDVLKLCPNIKKKVDVVICLSTTVRNDTLQEAKEHRVSLKCRRQLRVEELEMTEDIRLEPDLYEACKSDIKNFCSAVQYGNAQIIECLKENKKQLSTRCHQKVFKLQETEMMDPELDYTLMRVCKQMIKRFCPEADSKTMLQCLKQNKNSELMDPKCKQMITKRQITQNTDYRLNPMLRKACKADIPKFCHGILTKAKDDSELEGQVISCLKLRYADQRLSSDCEDQIRIIIQESALDYRLDPQLQLHCSDEISSLCAEEAAAQEQTGQVEECLKVNLLKIKTELCKKEVLNMLKESKADIFVDPVLHTACALDIKHHCAAITPGRGRQMSCLMEALEDKRVRLQPECKKRLNDRIEMWSYAAKVAPADGFSDLAMQVMTSPSKNYILSVISGSICILFLIGLMCGRITKRVTRELKDR

SEQ ID NO: 54 - protein, 253 aa, Homo sapiens
MGEFNEKKTTCGTVCLKYLLFTYNCCFWLAGLAVMAVGIWTLALKSDYISLLASGTYLATAYILVVAGTVVMVTGVLGCCATFKERRNLLRLYFILLLIIFLLEIIAGILAYAYYQQLNTELKENLKDTMTKRYHQPGHEAVTSAVDQLQQEFHCCGSNNSQDWRDSEWIRSQEAGGRVVPDSCCKTVVALCGQRDHASNIYKVEGGCITKLETFIQEHLRVIGAVGIGIACVQVFGMIFTCCLYRSLKLEHY

SEQ ID NO: 55 - protein, 253 aa, Homo sapiens [sequence omitted]

SEQ ID NO: 56 - protein, 541 aa, Homo sapiens
MVADPPRDSKGLAAAEPTANGGLALASIEDQGAAAGGYCGSRDQVRRCLRANLLVLLTVVAVVAGVALGLGVSGAGGALALGPERLSAFVFPGELLLRLLRMIILPLVVCSLIGGAASLDPGALGRLGAWALLFFLVTTLLASALGVGLALALQPGAASAAINASVGAAGSAENAPSKEVLDSFLDLARNIFPSNLVSAAFRSYSTTYEERNITGTRVKVPVGQEVEGMNILGLVVFAIVFGVALRKLGPEGELLIRFFNSFNEATMVLVSWIMWYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVDRSCTVLNVEGDALGAGLLQNYVDRTESRSTEPELIQVKSELPLDPLPVPTEEGNPLLKHYRGPAGDATVASEKESVM

SEQ ID NO: 57 - protein, 760 aa, Homo sapiens
MMDQARSAFSNLFGGEPLSYTRFSLARQVDGDNSHVEMKLAVDEEENADNNTKANVTKPKRCSGSICYGTIAVIVFFLIGFMIGYLGYCKGVEPKTECERLAGTESPVREEPGEDFPAARRLYWDDLKRKLSEKLDSTDFTSTIKLLNENSYVPREAGSQKDENLALYVENQFREFKLSKVWRDQHFVKIQVKDSAQNSVIIVDKNGRLVYLVENPGGYVAYSKAATVTGKLVHANFGTKKDFEDLYTPVNGSIVIVRAGKITFAEKVANAESLNAIGVLIYMDQTKFPIVNAELSFFGHAHLGTGDPYTPGFPSFNHTQFPPSRSSGLPNIPVQTISRAAAEKLFGNMEGDCPSDWKTDSTCRMVTSESKNVKLTVSNVLKEIKILNIFGVIKGFVEPDHYVVVGAQRDAWGPGAAKSGVGTALLLKLAQMFSDMVLKDGFQPSRSIIFASWSAGDFGSVGATEWLEGYLSSLHLKAFTYINLDKAVLGTSNFKVSASPLLYTLIEKTMQNVKHPVTGQFLYQDSNWASKVEKLTLDNAAFPFLAYSGIPAVSFCFCEDTDYPYLGTTMDTYKELIERIPELNKVARAAAEVAGQFVIKLTHDVELNLDYERYNSQLLSFVRDLNQYRADIKEMGLSLQWLYSARGDFFRATSRLTTDFGNAEKTDRFVMKKLNDRVMRVEYHFLSPYVSPKESPFRHVFWGSGSHTLPALLENLKLRKQNNGAFNETLFRNQLALATWTIQGAANALSGDVWDIDNEF

SEQ ID NO: 58 - protein, 589 aa, Homo sapiens
MRPLPGALGVAAAAALWLLLLLLPRTRADEHEHTYQDKEEVVLWMNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 59 - protein, 545 aa, Homo sapiens
MNTVGPYHNRQETYKYFSLPFCVGSKKSISHYHETLGEALQGVELEFSGLDIKFKDDVMPATYCEIDLDKEKRDAFVYAIKNHYWYQMYIDDLPIWGIVGEADENGEDYYLWTYKKLEIGFNGNRIVDVNLTSEGKVKLVPNTKIQMSYSVKWKKSDVKFEDRFDKYLDPSFFQHRIHWFSIFNSFMMVIFLVGLVSMILMRTLRKDYARYSKEEEMDDMDRDLGDEYGWKQVHGDVFRPSSHPLIFSSLIGSGCQIFAVSLIVIIVAMIEDLYTERGSMLSTAIFVYAATSPVNGYFGGSLYARQGGRRWIKQMFIGAFLIPAMVCGTAFFINFIAIYYHASRAIPFGTMVAVCCICFFVILPLNLVGTILGRNLSGQPNFPCRVNAVPRPIPEKKWFMEPAVIVCLGGILPFGSIFIEMYFIFTSFWAYKIYYVYGFMMLVLVILCIVTVCVTIVCTYFLLNAEDYRWQWTSFLSAASTAIYVYMYSFYYYFFKTKMYGLFQTSFYFGYMAVFSTALGIMCGAIGYMGTSAFVRKIYTNVKID

SEQ ID NO: 60 - protein, 1212 aa, Homo sapiens
MEPRPTAPSSGAPGLAGVGETPSAAALAAARVELPGTAVPSVPEDAAPASRDGGGVRDEGPAAAGDGLGRPLGPTPSQSRFQVDLVSENAGRAAAAAAAAAAAAAAAGAGAGAKQTPADGEASGESEPAKGSEEAKGRFRVNFVDPAASSSAEDSLSDAAGVGVDGPNVSFQNGGDTVLSEGSSLHSGGGGGSGHHQHYYYDTHTNTYYLRTFGHNTMDAVPRIDHYRHTAAQLGEKLLRPSLAELHDELEKEPFEDGFANGEESTPTRDAVVTYTAESKGVVKFGWIKGVLVRCMLNIWGVMLFIRLSWIVGQAGIGLSVLVIMMATVVTTITGLSTSAIATNGFVRGGGAYYLISRSLGPEFGGAIGLIFAFANAVAVAMYVVGFAETVVELLKEHSILMIDEINDIRIIGAITVVILLGISVAGMEWEAKAQIVLLVILLLAIGDFVIGTFIPLESKKPKGFFGYKSEIFNENFGPDFREEETFFSVFAIFFPAATGILAGANISGDLADPQSAIPKGTLLAILITTLVYVGIAVSVGSCVVRDATGNVNDTIVTELTNCTSAACKLNFDFSSCESSPCSYGLMNNFQVMSMVSGFTPLISAGIFSATLSSALASLVSAPKIFQALCKDNIYPAFQMFAKGYGKNNEPLRGYILTFLIALGFILIAELNVIAPIISNFFLASYALINFSVFHASLAKSPGWRPAFKYYNMWISLLGAILCCIVMFVINWWAALLTYVIVLGLYIYVTYKKPDVNWGSSTQALTYLNALQHSIRLSGVEDHVKNFRPQCLVMTGAPNSRPALLHLVHDFTKNVGLMICGHVHMGPRRQAMKEMSIDQAKYQRWLIKNKMKAFYAPVHADDLREGAQYLMQAAGLGRMKPNTLVLGFKKDWLQADMRDVDMYINLFHDAFDIQYGVVVIRLKEGLDISHLQGQEELLSSQEKSPGTKDVVVSVEYSKKSDLDTSKPLSEKPITHKVEEEDGKTATQPLLKKESKGPIVPLNVADQKLLEASTQFQKKQGKNTIDVWWLFDDGGLTLLIPYLLTTKKKWKDCKIRVFIGGKINRIDHDRRAMATLLSKFRIDFSDIMVLGDINTKPKKENIIAFEEIIEPYRLHEDDKEQDIADKMKEDEPWRITDNELELYKTKTYRQIRLNELLKEHSSTANIIVMSLPVARKGAVSSALYMAWLEALSKDLPPILLVRGNHQSVLTFYS

SEQ ID NO: 61 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCDFFKRTRYYQIMPKYHAVRIREEERYPPPGSTLPTKKHWVTSWQTRDQYY

SEQ ID NO: 62 - protein, 1051 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRARTRALYEAKRQKAEMKSQPSETERLTDDY

SEQ ID NO: 63 - protein, 1066 aa, Homo sapiens
MGPGPSRAPRAPRLMLCALALMVAAGGCVVSAFNLDTRFLVVKEAGNPGSLFGYSVALHRQTERQQRYLLLAGAPRELAVPDGYTNRTGAVYLCPLTAHKDDCERMNITVKNDPGHHIIEDMWLGVTVASQGPAGRVLVCAHRYTQVLWSGSEDQRRMVGKCYVRGNDLELDSSDDWQTYHNEMCNSNTDYLETGMCQLGTSGGFTQNTVYFGAPGAYNWKGNSYMIQRKEWDLSEYSYKDPEDQGNLYIGYTMQVGSFILHPKNITIVTGAPRHRHMGAVFLLSQEAGGDLRRRQVLEGSQVGAYFGSAIALADLNNDGWQDLLVGAPYYFERKEEVGGAIYVFMNQAGTSFPAHPSLLLHGPSGSAFGLSVASIGDINQDGFQDIAVGAPFEGLGKVYIYHSSSKGLLRQPQQVIHGEKLGLPGLATFGYSLSGQMDVDENFYPDLLVGSLSDHIVLLRARPVINIVHKTLVPRPAVLDPALCTATSCVQVELCFAYNQSAGNPNYRRNITLAYTLEADRDRRPPRLRFAGSESAVFHGFFSMPEMRCQKLELLLMDNLRDKLRPIIISMNYSLPLRMPDRPRLGLRSLDAYPILNQAQALENHTEVQFQKECGPDNKCESNLQMRAAFVSEQQQKLSRLQYSRDVRKLLLSINVTNTRTSERSGEDAHEALLTLVVPPALLLSSVRPPGACQANETIFCELGNPFKRNQRMELLIAFEVIGVTLHTRDLQVQLQLSTSSHQDNLWPMILTLLVDYTLQTSLSMVNHRLQSFFGGTVMGESGMKTVEDVGSPLKYEFQVGPMGEGLVGLGTLVLGLEWPYEVSNGKWLLYPTEITVHGNGSWPCRPPGDLINPLNLTLSDPGDRPSSPQRRRRQLDPGGGQGPPPVTLAAAKKAKSETVLTCATGRAHCVWLECPIPDAPVVTNVTVKARVWNSTFIEDYRDFDRVRVNGWATLFLRTSIPTINMENKTTWFSVDIDSELVEELPAEIELWLVLVAVGAGLLLLGLIILLLWKCGFFKRTRYYQIMPKYHAVRIREEERYPPPGSTLPTKKHWVTSWQTRDQYY

SEQ ID NO: 64 - protein, 513 aa, Homo sapiens
MAPARTMARARLAPAGIPAVALWLLCTLGLQGTQAGPPPAPPGLPAGADCLNSFTAGVPGFVLDTNASVSNGATFLESPTVRRGWDCVRACCTTQNCNLALVELQPDRGEDAIAACFLINCLYEQNFVCKFAPREGFINYLTREVYRSYRQLRTQGFGGSGIPKAWAGIDLKVQPQEPLVLKDVENTDWRLLRGDTDVRVERKDPNQVELWGLKEGTYLFQLTVTSSDHPEDTANVTVTVLSTKQTEDYCLASNKVGRCRGSFPRWYYDPTEQICKSFVYGGCLGNKNNYLREEECILACRGVQGPSMERRHPVCSGTCQPTQFRCSNGCCIDSFLECDDTPNCPDASDEAACEKYTSGFDELQRIHFPSDKGHCVDLPDTGLCKESIPRWYYNPFSEHCARFTYGGCYGNKNNFEEEQQCLESCRGISKKDVFGLRREIPIPSTGSVEMAVAVFLVICIVVVVAILGYCFFKNQRKDFHGHHHHPPPTPASSTVSTTEDTEHLVYNHTTRPL

SEQ ID NO: 65 - protein, 252 aa, Homo sapiens
MAQLCGLRRSRAFLALLGSLLLSGVLAADRERSIHDFCLVSKVVGRCRASMPRWWYNVTDGSCQLFVYGGCDGNSNNYLTKEECLKKCATVTENATGDLATSRNAADSSVPSAPRRQDSEDHSSDMFNYEEYCTANAVTGPCRASFPRWYFDVERNSCNNFIYGGCRGNKNSYRSEEACMLRCFRQQENPPLPLGSKVVVLAGLFVMVLILFLGASMVYLIRVARRNQERALRTVWSSGDDKEQLVKNTYVL

SEQ ID NO: 66 - protein, 197 aa, Homo sapiens [sequence omitted]

SEQ ID NO: 67 - protein, 388 aa, Homo sapiens
MSILKIHARELFDSRGNPTVEVDLFTSEGLFRAAVPSGASTGIYEVLELQDNDKTRYMGKGVSKPVEPINKTIAPVLVSKKLNVTEQEKIDKLMIEMDGTENKSKFGANAILGVSLAACKASAVEKGVPLYHHIADLSGNSKVILPVPVFNVINGSSHAVTKLAMQEFMVLPVGAANFREAMPIGAEVYHSLKNVIKEKYGKDATGVGDGGAFAPNILENKEGLELLKTAIGKAGYTDKVIVSMDVEASEFFRSGKYDLEFKFLDDPTRYISPDCLADLYKSFIKNYPVVSTEDPFDQDDWGAWQKFTASAGIQVVEDDLRVTNPKRTASAVNEKKCNCLLLKVNQIRSVTESLQACKLAQANGWCVMVPHHSGETENTFITDLVVGL

SEQ ID NO: 68 - protein, 434 aa, Homo sapiens
MAMQKIFAREILDSRGNPTVEVDLHTAKGRFRAAVPSGASTGIYEALELRDGDKGRYLGKGVLKAVENINNTLGPALLQKKLSVVDQEKVDKFMIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 69 - protein, 341 aa, Homo sapiens
MIELDGTENKSKFGANAILGVSLAVCKAGAAEKGVPLYRHIADLAGNPDLILPVPAFNVINGGSHAGNKLAMQEFMILPVGASSFKEAMRIGAEVYHHLKGVIKAKYGKDATNVGDEGGFAPNILENNEALELLKTAIQAAGYPDKVVIGMDVAASEFYRNGKYDLDFKSPDDPARHITGEKLGELYKSFIKNYPVVSIEDPFDQDDWATWTSFLSGVNIQIVGDDLTVTNPKRIAQAVEKKACNCLLLKVNQIGSVTESIQACKLAQSNGWGVMVSHRSGETEDTFIADLVVGLCTGQIKTGAPCRSERLAKYNQLMRIEEALGDKAIFAGRKFRNPKAK

SEQ ID NO: 70 - protein, 434 aa, Homo sapiens
MSIEKIWAREILDSRGNPTVEVDLYTAKGLFRAAVPSGASTGIYEALELRDGDKQRYLGKGVLKAVDHINSTIAPALISSGLSVVEQEKLDNLMLELDGTENKSKFGANAILGVSLAVCKAGAAERELPLYRHIAQLAGNSDLILPVPAFNVINGGSHAGNKLAMQEFMILPVGAESFRDAMRLGAEVYHTLKGVIKDKYGKDATNVGDEGGFAPNILENSEALELVKEAIDKAGYTEKIVIGMDVAASEFYRDGKYDLDFKSPTDPSRYITGDQLGALYQDFVRDYPVVSIEDPFDQDDWAAWSKFTANVGIQIVGDDLTVTNPKRIERAVEEKACNCLLLKVNQIGSVTEAIQACKLAQENGWGVMVSHRSGETEDTFIADLVVGLCTGQIKTGAPCRSERLAKYNQLMRIEEELGDEARFAGHNFRNPSVL

SEQ ID NO: 71 - protein, 323 aa, Homo sapiens
MARGPGLAPPPLRLPLLLLVLAAVTGHTAAQDNCTCPTNKMTVCSPDGPGGRCQCRALGSGMAVDCSTLTSKCLLLKARMSAPKNARTLVRPSEHALVDNDGLYDPDCDPEGRFKARQCNQTSVCWCVNSVGVRRTDKGDLSLRCDELVRTHHILIDLRHRPTAGAFNHSDLDAELRRLFRERYRLHPKFVAAVHYEQPTIQIELRQNTSQKAAGEVDIGDAAYYFERDIKGESLFQGRGGLDLRVRGEPLQVERTLIYYLDEIPPKFSMKRLTAGLIAVIVVVVVALVAGMAVLVITNRRKSGKYKKVEIKELGELRKEPSL

SEQ ID NO: 72 - protein, 434 aa, Homo sapiens
MSILKIHAREIFDSRGNPTVEVDLFTSKGLFRAAVPSGASTGIYEALELRDNDKTRYMGKGVSKAVEHINKTIAPALVSKKLNVTEQEKIDKLMIEMDGTENKSKFGANAILGVSLAVCKAGAVEKGVPLYRHIADLAGNSEVILPVPAFNVINGGSHAGNKLAMQEFMILPVGAANFREAMRIGAEVYHNLKNVIKEKYGKDATNVGDEGGFAPNILENKEGLELLKTAIGKAGYTDKVVIGMDVAASEFFRSGKYDLDFKSPDDPSRYISPDQLADLYKSFIKDYPVVSIEDPFDQDDWGAWQKFTASAGIQVVGDDLTVTNPKRIAKAVNEKSCNCLLLKVNQIGSVTESLQACKLAQANGWGVMVSHRSGETEDTFIADLVVGLCTGQIKTGAPCRSERLAKYNQLLRIEEELGSKAKFAGRNFRNPLAK

SEQ ID NO: 73 - protein, 659 aa, Homo sapiens
MGKLKLQSIRSVMQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 74 - protein, 647 aa, Homo sapiens
MQKYLEDRGEVTFEKIFSQKLGYLLFRDFCLNHLEEARPLVEFYEEIKKYEKLETEEERVARSREIFDSYIMKELLACSHPFSKSATEHVQGHLGKKQVPPDLFQPYIEEICQNLRGDVFQKFIESDKFTRFCQWKNVELNIHLTMNDFSVHRIIGRGGFGEVYGCRKADTGKMYAMKCLDKKRIKMKQGETLALNERIMLSLVSTGDCPFIVCMSYAFHTPDKLSFILDLMNGGDLHYHLSQHGVFSEADMRFYAAEIILGLEHMHNRFVVYRDLKPANILLDEHGHVRISDLGLACDFSKKKPHASVGTHGYMAPEVLQKGVAYDSSADWFSLGCMLFKLLRGHSPFRQHKTKDKHEIDRMTLTMAVELPDSFSPELRSLLEGLLQRDVNRRLGCLGRGAQEVKESPFFRSLDWQMVFLQKYPPPLIPPRGEVNAADAFDIGSFDEEDTKGIKLLDSDQELYRNFPLTISERWQQEVAETVFDTINAETDRLEARKKAKNKQLGHEEDYALGKDCIMHGYMSKMGNPFLTQWQRRYFYLFPNRLEWRGEGEAPQSLLTMEEIQSVEETQIKERKCLLLKIRGGKQFILQCDSDPELVQWKKELRDAYREAQQLVQRVPKMKNKPRSPVVELSKVPLVQRGSANGL

SEQ ID NO: 75 - protein, 146 aa, Homo sapiens
MPDAALSLMRSPRNCRESLPVLLFLCLLLKTCEPKTANAFKPNILLIMADDLGIGDLGCYGNNTLRMPNIDQLAEEGVRLTQHLAATLLCTPSRAAFLMGRHSFRSGMDASNGYWALQWNAGSGGSLRTKPLLQESCSTATMQLAS

SEQ ID NO: 76 - protein, 426 aa, Homo sapiens [sequence omitted]

SEQ ID NO: 77 - protein, 593 aa, Homo sapiens [sequence omitted]

SEQ ID NO: 78 - protein, 557 aa, Homo sapiens [sequence omitted]

SEQ ID NO: 79 - protein, 181 aa, Homo sapiens
MRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGVDMWEPHIIRWLGIFVIKKIPGQAWWRTPVVPAT

SEQ ID NO: 80 - protein, 382 aa, Homo sapiens
MRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFCVSARAVTGMAGVGCLFFISWYSSFGFVRRWNCILMRNHDVTEQPMVLEKTASLMLKEAVSYIERHKHGPFLLFLSLLHVHIPLVTTSAFLGKSQHGLYGDNVEEMDWLIASDFMSSSEVTESEAIKLMFRTMQRRCLPSMAFKKPWRGPVRLQILKRA

SEQ ID NO: 81 - protein, 57 aa, Homo sapiens
MFELVICLLLKMHFKYQIYLKDKIASVKLNIILCALGYALKCQFIIPKDVFIDVYQE

SEQ ID NO: 82 - protein, 670 aa, Homo sapiens [sequence omitted]

SEQ ID NO: 83 - protein, 287 aa, Homo sapiens
MIWAECKEIWTQGPKEYLFELWNMLDFGMLAILSASFIARFRAFWHASKAQSITDASDTLKDLTKVTLGDNVKYYSLARREWDPSDPRMVSEGLCAVAVVLSFSGIACILPANESFGPLQMSLGGAVKDIFRFMLIFIMVFVAFMIGMFNLYSYYIDVKQNEAFTTVEESFKTLFWATFVLSAVKSVVINYSHKFIENIGYVLYGVYDVTMVIVLLNMLIAMINSSLQEIEDDADVEWKFARAKLWFSCFGEGRALPVPFNLVPGPGSLFCLLLKLKGWISELYPGS

SEQ ID NO: 84 - protein, 123 aa, Homo sapiens
MAWTIASSSYSSGNMTLMFKPPDVLSSYITSDQLVGRYKSFIKDYSVVSTEDALDQDDRETWQKLSASAGYIHVTGNHLPVPSRKGTTKTTDKDSGNCLLLKVNQTDPMMESLQECKVAQAEG

SEQ ID NO: 85 - protein, 1051 aa, Homo sapiens
MFGRSRSWVGGGHGKTSRNIHSLDHLKYLYHVLTKNTTVTEQNRNLLVETIRSITEILIWGDQNDSSVFDFFLEKNMFVFFLNILRQKSGRYVCVQLLQTLNILFENISHETSLYYLLSNNYVNSIIVHKFDFSDEEIMAYYISFLKTLSLKLNNHTVHFFYNEHTNDFALYTEAIKFFNHPESMVRIAVRTITLNVYKVDNQAMLHYIRDKTAVPYFSNLVWFIGSHVIELDDCVQTDEEHRNRGKLSDLVAEHLDHLHYLNDILIINCEFLNDVLTDHLLNRLFLPLYVYSLENQDKGGERPKISLPVSLYLLSQVFLIIHHAPLVNSLAEVILNGDLSEMYAKTEQDIQRSSAKPSIRCFIKPTETLERSLEMNKHKGKRRVQKRPNYKNVGEEEDEEKGPTEDAQEDAEKAKGTEGGSKGIKTSGESEEIEMVIMERSKLSELAASTSVQEQNTTDEEKSAAATCSESTQWSRPFLDMVYHALDSPDDDYHALFVLCLLYAMSHNKGMDPEKLERIQLPVPNAAEKTTYNHPLAERLIRIMNNAAQPDGKIRLATLELSCLLLKQQVLMSAGCIMKDVHLACLEGAREESVHLVRHFYKGEDIFLDMFEDEYRSMTMKPMNVEYLMMDASILLPPTGTPLTGIDFVKRLPCGDVEKTRRAIRVFFMLRSLSLQLRGEPETQLPLTREEDLIKTDDVLDLNNSDLIACTVITKDGGMVQRFLAVDIYQMSLVEPDVSRLGWGVVKFAGLLQDMQVTGVEDDSRALNITIHKPASSPHSKPFPILQATFIFSDHIRCIIAKQRLAKGRIQARRMKMQRIAALLDLPIQPTTEVLGFGLGSSTSTQHLPFRFYDQGRRGSSDPTVQRSVFASVDKVPGFAVAQCINQHSSPSLSSQSPPSASGSPSGSGSTSHCDSGGTSSSSTPSTAQSPADAPMSPELPKPHLPDQLVIVNETEADSKPSKNVARSAAVETASLSPSLVPARQPTISLLCEDTADTLSVESLTLVPPVDPHSLRSLTGMPPLSTPAAACTEPVGEEAACAEPVGTAED

SEQ ID NO: 86 - protein, 344 aa, Homo sapiens
MRDTEALLWFTQKDGNHTGPEIRTRVKNWYLRMEKARTKWNHERDPRSVGRVGEWAWLASSFLYSSGSNFSSAESNREDLPLAARAFSDEDIVFALAMTKSVISGKFLNLPELLFSLQFNNNNNMRLLWVNERCCFLELRPLSITCLASSASKKCSVLFHLRQKSLSGKRLISHDCTPARLTSQTMQLLCSWEKKDNYLHGQVPVASFPVANYCVVLCVALLGHGSQLLQGVKFEAGEVEKEHRICSQVSKSQVSKEEALTAQCGGRHDGLKEAKTSGRTALFQCLWDAIFQKKLVPATHPRHFEIQQNHHCWQTFAADSLKGYVVILSTRLTQRTMRQGGARV

SEQ ID NO: 87 - protein, 948 aa, Homo sapiens [sequence omitted]

SEQ ID NO: 88 - protein, 243 aa, Homo sapiens [sequence omitted]

SEQ ID NO: 89 - protein, 946 aa, Homo sapiens
MTDSKYFTTTKKGEIFELKAELNSDKKEKKKEAVKKVIASMTVGKDVSALFPDVVNCMQTDNLELKKLVYLYLMNYAKSQPDMAIMAVNTFVKDCEDPNPLIRALAVRTMGCIRVDKITEYLCEPLRKCLKDEDPYVRKTAAVCVAKLHDINAQLVEDQGFLDTLKDLISDSNPMVVANAVAALSEIAESHPSSNLLDLNPQSINKLLTALNECTEWGQIFILDCLANYMPKDDREAQSICERVTPRLSHANSAVVLSAVKVLMKFMEMLSKDLDYYGTLLKKLAPPLVTLLSAEPELQYVALRNINLIVQKRPEILKHEMKVFFVKYNDPIYVKLEKLDIMIRLASQANIAQVLAELKEYATEVDVDFVRKAVRAIGRCAIKVEQSAERCVSTLLDLIQTKVNYVVQEAIVVIKDIFRKYPNKYESVIATLCENLDSLDEPEARAAMIWIVGEYAERIDNADELLESFLEGFHDESTQVQLQLLTAIVKLFLKKPTETQELVQQVLSLATQDSDNPDLRDRGYIYWRLLSTDPVAAKEVVLAEKPLISEETDLIEPTLLDELICYIGTLASVYHKPPSAFVEGGRGVVHKSLPPRTASSESAESPETAPTGAPPGEQPDVIPAQGDLLGDLLNLDLGPPVSGPPLATSSVQMGAVDLLGGGLDSLMGDEPEGIGGTNFVAPPTAAVPANLGAPIGSGLSDLFDLTSGVGTLSGSYVAPKAVWLPAMKAKGLEISGTFTRQVGSISMDLQLTNKALQVMTDFAIQFNRNSFGLAPAAPLQVHAPLSPNQTVEISLPLSTVGSVMKMEPLNNLQVAVKNNIDVFYFSTLYPLHILFVEDGKMDRQMFLATWKDIPNENEAQFQIRDCPLNAEAASSKLQSSNIFTVAKRNVEGQDMLYQSLKLTNGIWVLAELRIQPGNPSCTLSLKCRAPEVSQHVYQAYETILKN

SEQ ID NO: 90 - protein, 937 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 91 - protein, 935 aa, Homo sapiens [sequence omitted]

SEQ ID NO: 92 - protein, 934 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 93 - protein, 949 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 94 - protein, 949 aa, Homo sapiens [sequence omitted]

SEQ ID NO: 95 - protein, 951 aa, Homo sapiens
MTDSKYFTTNKKGEIFELKAELNNEKKEKRKEAVKKVIAAMTVGKDVSSLFPDVVNCMQTDNLELKKLVYLYLMNYAKSQPDMAIMAVNSFVKDCEDPNPLIRALAVRTMGCIRVDKITEYLCEPLRKCLKDEDPYVRKTAAVCVAKLHDINAQMVEDQGFLDSLRDLIADSNPMVVANAVAALSEISESHPNSNLLDLNPQNINKLLTALNECTEWGQIFILDCLSNYNPKDDREAQSICERVTPRLSHANSAVVLSAVKVLMKFLELLPKDSDYYNMLLKKLAPPLVTLLSGEPEVQYVALRNINLIVQKRPEILKQEIKVFFVKYNDPIYVKLEKLDIMIRLASQANIAQVLAELKEYATEVDVDFVRKAVRAIGRCAIKVEQSAERCVSTLLDLIQTKVNYVVQEAIVVIRDIFRKYPNKYESIIATLCENLDSLDEPDARAAMIWIVGEYAERIDNADELLESFLEGFHDESTQVQLTLLTAIVKLFLKKPSETQELVQQVLSLATQDSDNPDLRDRGYIYWRLLSTDPVTAKEVVLSEKPLISEETDLIEPTLLDELICHIGSLASVYHKPPNAFVEGSHGIHRKHLPIHHGSTDAGDSPVGTTTATNLEQPQVIPSQGDLLGDLLNLDLGPPVNVPQVSSMQMGAVDLLGGGLDSLLGSDLGGGIGGSPAVGQSFIPSSVPATFAPSPTPAVVSSGLNDLFELSTGIGMAPGGYVAPKAVWLPAVKAKGLEISGTFTHRQGHIYMEMNFTNKALQHMTDFAIQFNKNSFGVIPSTPLAIHTPLMPNQSIDVSLPLNTLGPVMKMEPLNNLQVAVKNNIDVFYFSCLIPLNVLFVEDGKMERQVFLATWKDIPNENELQFQIKECHLNADTVSSKLQNNNVYTIAKRNVEGQDMLYQSLKLTNGIWILAELRIQPGNPNYTLSLKCRAPEVSQYIYQVYDSILKN

SEQ ID NO: 96 - protein, 321 aa, Homo sapiens
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEKLYKSMKGLGTDDNTLIRVMVSRAEIDMLDIRAHFKRLYGKSLYSFIKGDTSGDYRKVLLVLCGGDD

SEQ ID NO: 97 - protein, 277 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 98 - protein, 194 aa, Homo sapiens
MLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVAACGFDLFFNLLERERKQKWDIEGSAVLCAGCGMLLHLSLLLAQGSVFLPTFLWGKVFNPLMLPSSCLGHVPRNLD

SEQ ID NO: 99 - protein, 877 aa, Homo sapiens
MLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 100 - protein, 906 aa, Homo sapiens
MPLRLDIKRKLTARSDRVKSVDLHPTEPWMLASLYNGSVCVWNHETQTLVKTFEVCDLPVRAAKFVARKNWVVTGADDMQIRVFNYNTLERVHMFEAHSDYIRCIAVHPTQPFILTSSDDMLIKLWDWDKKWSCSQVFEGHTHYVMQIVINPKDNNQFASASLDRTIKVWQLGSSSPNFTLEGHEKGVNCIDYYSGGDKPYLISGADDRLVKIWDYQNKTCVQTLEGHAQNVSCASFHPELPIIITGSEDGTVRIWHSSTYRLESTLNYGMERVWCVASLRGSNNVALGYDEGSIIVKLGREEPAMSMDANGKIIWAKHSEVQQANLKAMGDAEIKDGERLPLAVKDMGSCEIYPQTIQHNPNGRFVVVCGDGEYIIYTAMALRNKSFGSAQEFAWAHDSSEYAIRESNSIVKIFKNFKEKKSFKPDFGAESIYGGFLLGVRSVNGLAFYDWDNTELIRRIEIQPKHIFWSDSGELVCIATEESFFILKYLSEKVLAAQETHEGVTEDGIEDAFEVLGEIQEIVKTGLWVGDCFIYTSSVNRLNYYVGGEIVTIAHLDRTMYLLGYIPKDNRLYLGDKELNIISYSLLVSVLEYQTAVMRRDFSMADKVLPTIPKEQRTRVAHFLEKQGFKQQALTVSTDPEHRFELALQLGELKIAYQLAVEAESEQKWKQLAELAISKCQFGLAQECLHHAQDYGGLLLLATASGNANMVNKLAEGAERDGKNNVAFMSYFLQGKVDACLELLIRTGRLPEAAFLARTYLPSQVSRVVKLWRENLSKVNQKAAESLADPTEYENLFPGLKEAFVVEEWVKETHADLWPAKQYPLVTPNEERNVMEEGKDFQPSRSTAQQELDGKPASPTPVIVASHTANKEEKSLLELEVDLDNLELEDIDTTDINLDEDILDD

SEQ ID NO: 101 - protein, 212 aa, Homo sapiens
MNIFRLTGDLSHLAAIVILLLKIWKTRSCAGISGKSQLLFALVFTTRYLDLFTSFISLYNTSMKVIYLACSYATVYLIYLKFKATYDGNHDTFRVEFLVVPVGGLSFLVNHDFSPLEILWTFSIYLESVAILPQLFMISKTGEAETITTHYLFFLGLYRALYLVNWIWRFYFEGFFDLIAVVAGVVQTILYCDFFYLYITKVLKGKKLSLPA

SEQ ID NO: 102 - protein, 212 aa, Homo sapiens
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEILWTFSIYLESVAILPQLFMVSKTGEAETITSHYLFALGVYRTLYLFNWIWRYHFEGFFDLIAIVAGLVQTVLYCDFFYLYITKVLKGKKLSLPA

SEQ ID NO: 103 - protein, 317 aa, Homo sapiens
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEEDRPGWPDVLIFSTEAIIQEFSDPLDLLHLPGVSGHLAAAVHGEQDRRGGDHHQPLLVCARRLPHALSLQLDLALPFRGLLRPHRHCGRPGPDSPLLRFLLPLYHQSPKGEEVEFAGIAPVLSISLLGSSGRQRKAAEDEELSHPGVTFLRTHLLCSPSRLLPGFRGTVEDPGLGELRTWAVCSFLPFRQEKKIFPLFSF

SEQ ID NO: 104 - protein, 315 aa, Homo sapiens
MNLFRFLGDLSHLLAIILLLLKIWKSRSCAGISGKSQVLFAVVFTARYLDLFTNYISLYNTCMKVVYIACSFTTVWLIYSKFKATYDGNHDTFRVEFLVVPTAILAFLVNHDFTPLEHQLTWLHESLPGGFWMILGADPLDLLHLPGVSGHLAAAVHGEQDRRGGDHHQPLLVCARRLPHALSLQLDLALPFRGLLRPHRHCGRPGPDSPLLRFLLPLYHQSPKGEEVEFAGIAPVLSISLLGSSGRQRKAAEDEELSHPGVTFLRTHLLCSPSRLLPGFRGTVEDPGLGELRTWAVCSFLPFRQEKKIFPLFSF

SEQ ID NO: 105 - protein, 153 aa, Homo sapiens [sequence omitted]

SEQ ID NO: 106 - protein, 478 aa, Homo sapiens
MGRCCFYTAGTLSLLLLVTSVTLLVARVFQKAVDQSIEKKIVLRNGTEAFDSWEKPPLPVYTQFYFFNVTNPEEILRGETPRVEEVGPYTYRELRNKANIQFGDNGTTISAVSNKAYVFERDQSVGDPKIDLIRTLNIPVLTVIEWSQVHFLREIIEAMLKAYQQKLFVTHTVDELLWGYKDEILSLIHVFRPDISPYFGLFYEKNGTNDGDYVFLTGEDSYLNFTKIVEWNGKTSLDWWITDKCNMINGTDGDSFHPLITKDEVLYVFPSDFCRSVYITFSDYESVQGLPAFRYKVPAEILANTSDNAGFCIPEGNCLGSGVLNVSICKNGAPIIMSFPHFYQADERFVSAIEGMHPNQEDHETFVDINPLTGIILKAAKRFQINIYVKKLDDFVETGDIRTMVFPVMYLNESVHIDKETASRLKSMINTTLIITNIPYIIMALGVFFGLVFTWLACKGQGSMDEGTADERAPLIRT

SEQ ID NO: 107 - protein, 745 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEDSSLLLATQVEGQATNLQRLAEPSQLLKSAIVHLINYQDDAELATRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMAVRLADGLQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDLDATYRPMYSSDVPLDPLEMHMDMDGDYPIDTYSDGLRPPYPTADHMLA

SEQ ID NO: 108 - protein, 744 aa, Homo sapiens
MEVMNLMEQPIKVTEWQQTYTYDSGIHSGANTCVPSVSSKGIMEEDEACGRQYTLKKTTTYTQGVPPSQGDLEYQMSTTARAKRVREAMCPGVSGEGQLALLATQVEGQATNLQRLAEPSQLLKSAIVHLINYQDDAELVTRALPELTKLLNDEDPVVVTKAAMIVNQLSKKEASRRALMGSPQLVAAVVRTMQNTSDLDTARCTTSILHNLSHHREGLLAIFKSGGIPALVRMLSSPVESVLFYAITTLHNLLLYQEGAKMACAGRRAQKMVPLLNKNNPKFLAITTDCLQLLAYGNQESKLIILANGGPQALVQIMRNYSYEKLLWTTSRVLKVLSVCPSNKPAIVEAGGMQALGKHLTSNSPRLVQNCLWTLRNLSDVATKQEGLESVLKILVNQLSVDDVNVLTCATGTLSNLTCNNSKNKTLVTQNSGVEALIHAILRAGDKDDITEPAVCALRHLTSRHPEAEMAQNSVRLNYGIPAIVKLLNQPNQWPLVKATIGLIRNLALCPANHAPLQEAAVIPRLVQLLVKAHQDAQRHVAAGTQQPYTDGVRMEEIVEGCTGALHILARDPMNRMEIFRLNTIPLFVQLLYSSVENIQRVAAGVLCELAQDKEAADAIDAEGASAPLMELLHSRNEGTATYAAAVLFRISEDKNPDYRKRVSVELTNSLFKHDPAAWEAAQSMIPINEPYGDDMDATYRPMYSSDVPLDPLEMHMDMDGDYPIDTYSDGLRPPYPTADHMLA

SEQ ID NO: 109 - protein, 303 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 110 - protein, 322 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 111 - protein, 657 aa, Homo sapiens
MRLKIGFILRSLLVVGSFLGLVVLWSSLTPRPDDPSPLSRMREDRDVNDPMPNRGGNGLAPGEDRFKPVVPWPHVEGVEVDLESIRRINKAKNEQEHHAGGDSQKDIMQRQYLTFKPQTFTYHDPVLRPGILGNFEPKEPEPPGVVGGPGEKAKPLVLGPEFKQAIQASIKEFGFNMVASDMISLDRSVNDLRQEECKYWHYDENLLTSSVVIVFHNEGWSTLMRTVHSVIKRTPRKYLAEIVLIDDFSNKEHLKEKLDEYIKLWNGLVKVFRNERREGLIQARSIGAQKAKLGQVLIYLDAHCEVAVNWYAPLVAPISKDRTICTVPLIDVINGNTYEIIPQGGGDEDGYARGAWDWSMLWKRVPLTPQEKRLRKTKTEPYRSPAMAGGLFAIEREFFFELGLYDPGLQIWGGENFEISYKIWQCGGKLLFVPCSRVGHIYRLEGWQGNPPPIYVGSSPTLKNYVRVVEVWWDEYKDYFYASRPESQALPYGDISELKKFREDHNCKSFKWFMEEIAYDITSHYPLPPKNVDWGEIRGFETAYCIDSMGKTNGGFVELGPCHRMGGNQLFRINEANQLMQYDQCLTKGADGSKVMITHCNLNEFKEWQYFKNLHRFTHIPSGKCLDRSEVLHQVFISNCDSSKTTQKWEMNNIHSV

SEQ ID NO: 112 - protein, 508 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 113 - protein, 185 aa, Homo sapiens
MTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 114 - protein, 357 aa, Homo sapiens
METRLPPRNIQDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 115 - protein, 280 aa, Homo sapiens
MAPSGSLAVPLAVLVLLLWGAPWTHGRRSNVRVITDENWRELLEGDWMIEFYAPWCPACQNLQPEWESFAEWGEDLEVNIAKVDVTEQPGLSGRFIITALPTIYHCKDGEFRRYQGPRTKKDFINFISDKEWKSIEPVSSWFGPGSVLMSSMSALFQLSMWIRTCHNYFIEDLGLPVWGSYTVFALATLFSGLLLGLCMIFVADCLCPSKRRRPQPYPYPSKKLLSESAQPLKKVEEEQEADEEDVSEEEAESKEGTNKDFPQNAIRQRSLGPSLATDKS

SEQ ID NO: 116 - protein, 2871 aa, Homo sapiens
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDAKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATRLKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 117 - protein, 2871 aa, Homo sapiens
MSCNGGSHPRINTLGRMIRAESGPDLRYEVTSGGGGTSRMYYSRRGVITDQNSDGYCQTGTMSRHQNQNTIQELLQNCSDCLMRAELIVQPELKYGDGIQLTRSRELDECFAQANDQMEILDSLIREMRQMGQPCDAYQKRLLQLQEQMRALYKAISVPRVRRASSKGGGGYTCQSGSGWDEFTKHVTSECLGWMRQQRAEMDMVAWGVDLASVEQHINSHRGIHNSIGDYRWQLDKIKADLREKSAIYQLEEEYENLLKASFERMDHLRQLQNIIQATSREIMWINDCEEEELLYDWSDKNTNIAQKQEAFSIRMSQLEVKEKELNKLKQESDQLVLNQHPASDKIEAYMDTLQTQWSWILQITKCIDVHLKENAAYFQFFEEAQSTEAYLKGLQDSIRKKYPCDKNMPLQHLLEQIKELEKEREKILEYKRQVQNLVNKSKKIVQLKPRNPDYRSNKPIILRALCDYKQDQKIVHKGDECILKDNNERSKWYVTGPGGVDMLVPSVGLIIPPPNPLAVDLSCKIEQYYEAILALWNQLYINMKSLVSWHYCMIDIEKIRAMTIAKLKTMRQEDYMKTIADLELHYQEFIRNSQGSEMFGDDDKRKIQSQFTDAQKHYQTLVIQLPGYPQHQTVTTTEITHHGTCQDVNHNKVIETNRENDKQETWMLMELQKIRRQIEHCEGRMTLKNLPLADQGSSHHITVKINELKSVQNDSQAIAEVLNQLKDMLANFRGSEKYCYLQNEVFGLFQKLENINGVTDGYLNSLCTVRALLQAILQTEDMLKVYEARLTEEETVCLDLDKVEAYRCGLKKIKNDLNLKKSLLATMKTELQKAQQIHSQTSQQYPLYDLDLGKFGEKVTQLTDRWQRIDKQIDFRLWDLEKQIKQLRNYRDNYQAFCKWLYDRKRRQDSLESMKFGDSNTVMRFLNEQKNLHSEISGKRDKSEEVQKIAELCANSIKDYELQLASYTSGLETLLNIPIKRTMIQSPSGVILQEAADVHARYIELLTRSGDYYRFLSEMLKSLEDLKLKNTKIEVLEEELRLARDANSENCNKNKFLDQNLQKYQAECSQFKAKLASLEELKRQAELDGKSAKQNLDKCYGQIKELNEKITRLTYEIEDEKRRRKSVEDRFDQQKNDYDQLQKARQCEKENLGWQKLESEKAIKEKEYEIERLRVLLQEEGTRKREYENELAKVRNHYNEEMSNLRNKYETEINITKTTIKEISMQKEDDSKNLRNQLDRLSRENRDLKDEIVRLNDSILQATEQRRRAEENALQQKACGSEIMQKKQHLEIELKQVMQQRSEDNARHKQSLEEAAKTIQDKNKEIERLKAEFQEEAKRRWEYENELSKVRNNYDEEIISLKNQFETEINITKTTIHQLTMQKEEDTSGYRAQIDNLTRENRSLSEEIKRLKNTLTQTTENLRRVEEDIQQQKATGSEVSQRKQQLEVELRQVTQMRTEESVRYKQSLDDAAKTIQDKNKEIERLKQLIDKETNDRKCLEDENARLQRVQYDLQKANSSATETINKLKVQEQELTRLRIDYERVSQERTVKDQDITRFQNSLKELQLQKQKVEEELNRLKRTASEDSCKRKKLEEELEGMRRSLKEQAIKITNLTQQLEQASIVKKRSEDDLRQQRDVLDGHLREKQRTQEELRRLSSEVEALRRQLLQEQESVKQAHLRNEHFQKAIEDKSRSLNESKIEIERLQSLTENLTKEHLMLEEELRNLRLEYDDLRRGRSEADSDKNATILELRSQLQISNNRTLELQGLINDLQRERENLRQEIEKFQKQALEASNRIQESKNQCTQVVQERESLLVKIKVLEQDKARLQRLEDELNRAKSTLEAETRVKQRLECEKQQIQNDLNQWKTQYSRKEEAIRKIESEREKSEREKNSLRSEIERLQAEIKRIEERCRRKLEDSTRETQSQLETERSRYQREIDKLRQRPYGSHRETQTECEWTVDTSKLVFDGLRKKVTAMQLYECQLIDKTTLDKLLKGKKSVEEVASEIQPFLRGAGSIAGASASPKEKYSLVEAKRKKLISPESTVMLLEAQAATGGIIDPHRNEKLTVDSAIARDLIDFDDRQQIYAAEKAITGFDDPFSGKTVSVSEAIKKNLIDRETGMRLLEAQIASGGVVDPVNSVFLPKDVALARGLIDRDLYRSLNDPRDSQKNFVDPVTKKKVSYVQLKERCRIEPHTGLLLLSVQKRSMSFQGIRQPVTVTELVDSGILRPSTVNELESGQISYDEVGERIKDFLQGSSCIAGIYNETTKQKLGIYEAMKIGLVRPGTALELLEAQAATGFIVDPVSNLRLPVEEAYKRGLVGIEFKEKLLSAERAVTGYNDPETGNIISLFQAMNKELIEKGHGIRLLEAQIATGGIIDPKESHRLPVDIAYKRGYFNEELSEILSDPSDDTKGFFDPNTEENLTYLQLKERCIKDEETGLCLLPLKEKKKQVQTSQKNTLRKRRVVIVDPETNKEMSVQEAYKKGLIDYETFKELCEQECEWEEITITGSDGSTRVVLVDRKTGSQYDIQDAIDKGLVDRKFFDQYRSGSLSLTQFADMISLKNGVGTSSSMGSGVSDDVFSSSRHESVSKISTISSVRNLTIRSSSFSDTLEESSPIAAIFDTENLEKISITEGIERGIVDSITGQRLLEAQACTGGIIHPTTGQKLSLQDAVSQGVIDQDMATSVKPAQKAFIGFEGVKGKKKMSAAEAVKEKWLPYEAGQRFLEFQYLTGGLVDPEVHGRISTEEAIRKGFIDGRAAQRLQDTSSYAKILTCPKTKLKISYKDAINRSMVEDITGLRLLEAASVSSKGLPSPYNMSSAPGSRSGSRSGSRSGSRSGSRSGSRRGSFDATGNSSYSYSYSFSSSSIGH

SEQ ID NO: 118 - protein, 1307 aa, Homo sapiens [sequence omitted]

SEQ ID NO: 119 - protein, 1394 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 120 - protein, 241 aa, Homo sapiens
MQCFSFIKTMMILFNLLIFLCGAALLAVGIWVSIDGASFLKIFGPLSSSAMQFVNVGYFLIAAGVVVFALGFLGCYGAKTESKCALVTFFFILLLIFIAEVAAAVVALVYTTMAEHFLTLLVVPAIKKDYGSQEDFTQVWNTTMKGLKCCGFTNYTDFEDSPYFKENSAFPPFCCNDNVTNTANETCTKQKAHDQKVEGCFNQLLYDIRTNAVTVGGVAAGIGGLELAAMIVSMYLYCNLQ

SEQ ID NO: 121 - protein, 193 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTG

SEQ ID NO: 122 - protein, 321 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRATRSTPVSRTTKHFHETTPNKGSGTTSGTTRLLSGHTCFTLTGLLGTLVTMGLLT

SEQ ID NO: 123 - protein, 440 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGSRPVTQAGMRWCDRSSLQSRTPGFKRSFHFSLPSSWYYRAHVFHVDRFAWDASNHGLADLAKEELRRKYTQVYRLFLVS

SEQ ID NO: 124 - protein, 376 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGQLTLFRFTEYGSNVLWWKYELDQDCRIKWSLIYCSQGFSY

SEQ ID NO: 125 - protein, 363 aa, Homo sapiens
GHLIVISFSSAFVSLGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 126 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVICLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 127 - protein, 381 aa, Homo sapiens
MTVARPSVPAALPLLGELPRLLLLVLLCLPAVWGDCGLPPDVPNAQPALEGRTSFPEDTVITYKCEESFVKIPGEKDSVTCLKGSQWSDIEEFCNRSCEVPTRLNSASLKQPYITQNYFPVGTVVEYECRPGYRREPSLSPKLTCLQNLKWSTAVEFCKKKSCPNPGEIRNGQIDVPGGILFGATISFSCNTGYKLFGSTSSFCLISGSSVQWSDPLPECREIYCPAPPQIDNGIIQGERDHYGYRQSVTYACNKGFTMIGEHSIYCTVNNDEGEWSGPPPECRGKSLTSKVPPTVQKPTTVNVPTTEVSPTSQKTTTKTTTPNAQATRSTPVSRTTKHFHETTPNKGSGTTSGTTRLLSGHTCFTLTGLLGTLVTMGLLT

SEQ ID NO: 128 - protein, 349 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIGKQMVELNMPLTRLNQPLQQSREAE

SEQ ID NO: 129 - protein, 369 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 130 - protein, 384 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGKADGGAEYATYQTKSTTPAEQRG

SEQ ID NO: 131 - protein, 377 aa, Homo sapiens
MEPPGRRECPFPSWRFPGLLLAAMVLLLYSFSDACEEPPTFEAMELIGKPKPYYEIGERVDYKCKKGYFYIPPLATHTICDRNHTWLPVSDDACYRETCPYIRDPLNGQAVPANGTYEFGYQMHFICNEGYYLIGEEILYCELKGSVAIWSGKPPICEKVLCTPPPKIKNGKHTFSEVEVFEYLDAVTYSCDPAPGPDPFSLIGESTIYCGDNSVWSRAAPECKVVKCRFPVVENGKQISGFGKKFYYKATVMFECDKGFYLDGSDTIVCDSNSTWDPPVPKCLKVSTSSTTKSPASSASGPRPTYKPPVSNYPGYPKPEEGILDSLDVWVIAVIVIAIVVGVAVICVVPYRYLQRRKKKGTYLTDETHREVKFTSL

SEQ ID NO: 132 - protein, 228 aa, Homo sapiens
MPVKGGTKCIKYLLFGFNFIFWLAGIAVLAIGLWLRFDSQTKSIFEQETNNNNSSFYTGVYILIGAGALMMLVGFLGCCGAVQESQCMLGLFFGFLLVIFAIEIAAAIWGYSHKDEVIKEVQEFYKDTYNKLKTKDEPQRETLKAIHYALNCCGLAGGVEQFISDICPKKDVLETFTVKSCPDAIKEVFDNKFHIIGAVGIGIAVVMIFGMIFSMILCCAIRRNREMV

SEQ ID NO: 133 - protein, 303 aa, Homo sapiens
MADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 134 - protein, 237 aa, Homo sapiens
MAGVSACIKYSMFTFNFLFWLCGILILALAIWVRVSNDSQAIFGSEDVGSSSYVAVDILIAVGAIIMILGFLGCCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 135 - protein, 583 aa, Homo sapiens [sequence omitted]

SEQ ID NO: 136 - protein, 532 aa, Homo sapiens [sequence omitted]

SEQ ID NO: 137 - protein, 570 aa, Homo sapiens [sequence omitted]

SEQ ID NO: 138 - protein, 583 aa, Homo sapiens
MESKGASSCRLLFCLLISATVFRPGLGWYTVNSAYGDTIIIPCRLDVPQNLMFGKWKYEKPDGSPVFIAFRSSTKKSVQYDDVPEYKDRLNLSENYTLSISNARISDEKRFVCMLVTEDNVFEAPTIVKVFKQPSKPEIVSKALFLETEQLKKLGDCISEDSYPDGNITWYRNGKVLHPLEGAVVIIFKKEMDPVTQLYTMTSTLEYKTTKADIQMPFTCSVTYYGPSGQKTIHSEQAVFDIYYPTEQVTIQVLPPKNAIKEGDNITLKCLGNGNPPPEEFLFYLPGQPEGIRSSNTYTLMDVRRNATGDYKCSLIDKKSMIASTAITVHYLDLSLNPSGEVTRQIGDALPVSCTISASRNATVVWMKDNIRLRSSPSFSSLHYQDAGNYVCETALQEVEGLKKRESLTLIVEGKPQIKMTKKTDPSGLSKTIICHVEGFPKPAIQWTITGSGSVINQTEESPYINGRYYSKIIISPEENVTLTCTAENQLERTVNSLNVSAISIPEHDEADEISDENREKVNDQAKLIVGIVVGLLLAALVAGVVYWLYMKKSKTASKHVNKDLGNMEENKKLEENNHKTEA

SEQ ID NO: 139 - protein, 687 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSEKSVPLCILYEKYRDCLTESNLIKVRALLVEPVINSYLLAERDLYLENPEIKIRILGEPKQKRKLVAEVSLQNPLPVALEGCTFTVEGAGLTEEQKTVEIPDPVEAGEEVKVRMDLLPLHMGLHKLVVNFESDKLKAVKGFRNVIIGPA

SEQ ID NO: 140 - protein, 349 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTGELHAGMWVMSPGRGHEEHWSRNQDIPALVLPPATNTLNALCGLEPVTTLSGPLSNSHPSSGC

SEQ ID NO: 141 - protein, 548 aa, Homo sapiens
MAEELVLERCDLELETNGRDHHTADLCREKLVVRRGQPFWLTLHFEGRNYEASVDSLTFSVVTGPAPSQEAGTKARFPLRDAVEEGDWTATVVDQQDCTLSLQLTTPANAPIGLYRLSLEASTGYQGSSFVLGHFILLFNAWCPADAVYLDSEEERQEYVLTQQGFIYQGSAKFIKNIPWNFGQFEDGILDICLILLDVNPKFLKNAGRDCSRRSSPVYVGRVVSGMVNCNDDQGVLLGRWDNNYGDGVSPMSWIGSVDILRRWKNHGCQRVKYGQCWVFAAVACTVLRCLGIPTRVVTNYNSAHDQNSNLLIEYFRNEFGEIQGDKSEMIWNFHCWVESWMTRPDLQPGYEGWQALDPTPQEKSEGTYCCGPVPVRAIKEGDLSTKYDAPFVFAEVNADVVDWIQQDDGSVHKSINRSLIVGLKISTKSVGRDEREDITHTYKYPEGSSEEREAFTRANHLNKLAEKEETGMAMRIRVGQSMNMGSDFDVFAHITNNTAEEYVCRLLLCARTVSYNGILGPECGTKYLLNLNLEPFSGKALCSWSIC

SEQ ID NO: 142 - protein, 560 aa, Homo sapiens [sequence omitted]

SEQ ID NO: 143 - protein, 559 aa, Homo sapiens
MNDYGFIYQGSKNWIRPCPWNYGQFEDKIIDICLKLLDKSLHFQTDPATDCALRGSPVYVSRVVCAMINSNDDNGVLNGNWSENYTDGANPAEWTGSVAILKQWNATGCQPVRYGQCWVFAAVMCTVMRCLGIPTRVITNFDSGHDTDGNLIIDEYYDNTGRILGNKKKDTIWNFHVWNECWMARKDLPPAYGGWQVLDATPQEMSNGVYCCGPASVRAIKEGEVDLNYDTPFVFSMVNADCMSWLVQGGKEQKLHQDTSSVGNFISTKSIQSDERDDITENYKYEEGSLQERQVFLKALQKLKARSFHGSQRGAELQPSRPTSLSQDSPRSLHTPSLRPSDVVQVSLKFKLLDPPNMGQDICFVLLALNMSSQFKDLKVNLSAQSLLHDGSPLSPFWQDTAFITLSPKEAKTYPCKISYSQYSQYLSTDKLIRISALGEEKSSPEKILVNKIITLSYPSITINVLGAAVVNQPLSIQVIFSNPLSEQVEDCVLTVEGSGLFKKQQKVFLGVLKPQHQASIILETVPFKSGQRQIQANMRSNKFKDIKGYRNVYVDFAL

SEQ ID NO: 144 - protein, 430 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 145 - protein, 1029 aa, Homo sapiens
MGLWGKKGTVAPHDQSPRRRPKKGLIKKKMVKREKQKRNMEELKKEVVMDDHKLTLEELSTKYSVDLTKGHSHQRAKEILTRDGPNTVTPPPTTPEWVKFCKQLFGGFSLLLWTGAILCFVAYSIQIYFNEEPTKDNLYLSIVLSVVVIVTGCFSYYQEAKSSKIMESFKNMVPQQALVIRGGEKMQINVQEVVLGDLVEIKGGDRVPADLRLISAQGCKVDNSSLTGESEPQSRSPDFTHENPLETRNICFFSTNCVEGTARGIVIATGDSTVMGRIASLTSGLAVGQTPIAAEIEHFIHLITVVAVFLGVTFFALSLLLGYGWLEAIIFLIGIIVANVPEGLLATVTVCLTLTAKRMARKNCLVKNLEAVETLGSTSTICSDKTGTLTQNRMTVAHMWFDMTVYEADTTEEQTGKTFTKSSDTWFMLARIAGLCNRADFKANQEILPIAKRATTGDASESALLKFIEQSYSSVAEMREKNPKVAEIPFNSTNKYQMSIHLREDSSQTHVLMMKGAPERILEFCSTFLLNGQEYSMNDEMKEAFQNAYLELGGLGERVLGFCFLNLPSSFSKGFPFNTDEINFPMDNLCFVGLISMIDPPRAAVPDAVSKCRSAGIKVIMVTGDHPITAKAIAKGVGIISEGTETAEEVAARLKIPISKVDASAAKAIVVHGAELKDIQSKQLDQILQNHPEIVFARTSPQQKLIIVEGCQRLGAVVAVTGDGVNDSPALKKADIGIAMGISGSDVSKQAADMILLDDNFASIVTGVEEGRLIFDNLKKSIMYTLTSNIPEITPFLMFIILGIPLPLGTITILCIDLGTDMVPAISLAYESAESDIMKRLPRNPKTDNLVNHRLIGMAYGQIGMIQALAGFFTYFVILAENGFRPVDLLGIRLHWEDKYLNDLEDSYGQQWTYEQRKVVEFTCQTAFFVTIVVVQWADLIISKTRRNSLFQQGMRNKVLIFGILEETLLAAFLSYTPGMDVALRMYPLKITWWLCAIPYSILIFVYDEIRKLLIRQHPDGWVERETYY

SEQ ID NO: 146 - protein, 254 aa, Homo sapiens
MQHASMPMAAAKQCKGIVDCIVRIPKDQGVLSFWRGNLANVIRYSPTQALNFAFKDKYKQIFLAGVDKHTQFCRYFAGNLASGGTAVVYPLDFTRTRLAADVGKSGTEREFRGLGDCLVKISKSDGIRGLYQGFSVSVQAIIIYQAAYFRVYDTANGMFPDPKNTHILVSWMTAQTVTAVAGVLSYPFDTVRRRTMMQSRRKGADIMYTGTVDCWRKIFRDERGEAFFKGVWSNALRGMGVGAGFVLVLYDELK

SEQ ID NO: 147 - protein, 298 aa, Homo sapiens
MTEQAISFAKDFLAGGIAAAISKTAVAPIERVKLLLQVQHASKQIAADKQYKGIVDCIVRIPKEQGVLSFWRGNLANVIRYFPTQALNFAFKDKYKQIFLGGVDKHTQFWRYFAGNLASGGAAGATSLCFVYPLDFARTRLAADVGKSGTEREFRGLGDCLVKITKSDGIRGLYQGFSVSVQGIIIYRAAYFGVYDTAKGMLPDPKNTHIVVSWMIAQTVTAVAGVVSYPFDTVRRRMMMQSGRKGADIMYTGTVDCWRKIFRDEGGKAFFKGAWSNVLRGMGGAFVLVLYDELKKVI

SEQ ID NO: 148 - protein, 418 aa, Homo sapiens [sequence omitted]

SEQ ID NO: 149 - protein, 418 aa, Homo sapiens
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLTVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 150 - protein, 724 aa, Homo sapiens
MPEEVHHGEEEVETFAFQAEIAQLMSLIINTFYSNKEIFLRELISNASDALDKIRYESLTDPSKLDSGKELKIDIIPNPQERTLTLVDTGIGMTKADLINNLGTIAKSGTKAFMEALQAGADISMIGQFGVGFYSAYLVAEKVVVITKHNDDEQYAWESSAGGSFTVRADHGEPIGRGTKVILHLKEDQTEYLEERRVKEVVKKHSQFIGYPITLYLEKEREKEISDDEAEEEKGEKEEEDKDDEEKPKIEDVGSDEEDDSGKDKKKKTKKIKEKYIDQEELNKTKPIWTRNPDDITQEEYGEFYKSLTNDWEDHLAVKHFSVEGQLEFRALLFIPRRAPFDLFENKKKKNNIKLYVRRVFIMDSCDELIPEYLNFIRGVVDSEDLPLNISREMLQQSKILKVIRKNIVKKCLELFSELAEDKENYKKFYEAFSKNLKLGIHEDSTNRRRLSELLRYHTSQSGDEMTSLSEYVSRMKETQKSIYYITGESKEQVANSAFVERVRKRGFEVVYMTEPIDEYCVQQLKEFDGKSLVSVTKEGLELPEDEEEKKKMEESKAKFENLCKLMKEILDKKVEKVTISNRLVSSPCCIVTSTYGWTANMERIMKAQALRDNSTMGYMMAKKHLEINPDHPIVETLRQKAEADKNDKAVKDLVVLLFETALLSSGFSLEDPQTHSNRIYRMIKLGLGIDEDEVAAEEPNAAVPDEIPPLEGDEDASRMEEVD

SEQ ID NO: 151 - protein, 732 aa, Homo sapiens
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 152 - protein, 1640 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQGLRASIDAYDNFDNISLAQQLEKHQLMEFRCIAAYLYKGNNWWAQSVELCKKDHLYKDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 153 - protein, 1583 aa, Homo sapiens
MAQILPVRFQEHFQLQNLGINPANIGFSTLTMESDKFICIREKVGEQAQVTIIDMSDPMAPIRRPISAESAIMNPASKVIALKAGKTLQIFNIEMKSKMKAHTMAEEVIFWKWVSVNTVALVTETAVYHWSMEGDSQPMKMFDRHTSLVGCQVIHYRTDEYQKWLLLVGISAQQNRVVGAMQLYSVDRKVSQPIEGHAAAFAEFKMEGNAKPATLFCFAVRNPTGGKLHIIEVGQPAAGNQPFVKKAVDVFFPPEAQNDFPVAMQIGAKHGVIYLITKYGYLHLYDLESGVCICMNRISADTIFVTAPHKPTSGIIGVNKKGQVLSVCVEEDNIVNYATNVLQNPDLGLRLAVRSNLAGAEKLFVRKFNTLFAQGSYAEAAKVAASAPKGILRTRETVQKFQSIPAQSGQASPLLQYFGILLDQGQLNKLESLELCHLVLQQGRKQLLEKWLKEDKLECSEELGDLVKTTDPMLALSVYLRANVPSKVIQCFAETGQFQKIVLYAKKVGYTPDWIFLLRGVMKISPEQGLQFSRMLVQDEEPLANISQIVDIFMENSLIQQCTSFLLDALKNNRPAEGLLQTWLLEMNLVHAPQVADAILGNKMFTHYDRAHIAQLCEKAGLLQQALEHYTDLYDIKRAVVHTHLLNPEWLVNFFGSLSVEDSVECLHAMLSANIRQNLQLCVQVASKYHEQLGTQALVELFESFKSYKGLFYFLGSIVNFSQDPDVHLKYIQAACKTGQIKEVERICRESSCYNPERVKNFLKEAKLTDQLPLIIVCDRFGFVHDLVLYLYRNNLQRYIEIYVQKVNPSRTPAVIGGLLDVDCSEEVIKHLIMAVRGQFSTDELVAEVEKRNRLKLLLPWLESQIQEGCEEPATHNALAKIYIDSNNSPECFLRENAYYDSSVVGRYCEKRDPHLACVAYERGQCDLELIKVCNENSLFKSEARYLVCRKDPELWAHVLEETNPSRRQLIDQVVQTALSETRDPEEISVTVKAFMTADLPNELIELLEKIVLDNSVFSEHRNLQNLLILTAIKADRTRVMEYISRLDNYDALDIASIAVSSALYEEAFTVFHKFDMNASAIQVLIEHIGNLDRAYEFAERCNEPAVWSQLAQAQLQKDLVKEAINSYIRGDDPSSYLEVVQSASRSNNWEDLVKFLQMARKKGRESYIETELIFALAKTSRVSELEDFINGPNNAHIQQVGDRCYEEGMYEAAKLLYSNVSNFARLASTLVHLGEYQAAVDNSRKASSTRTWKEVCFACMDGQEFRFAQLCGLHIVIHADELEELMCYYQDRGYFEELILLLEAALGLERAHMGMFTELAILYSKFKPQKMLEHLELFWSRVNIPKVLRAAEQAHLWAELVFLYDKYEEYDNAVLTMMSHPTEAWKEGQFKDIITKVANVELCYRALQFYLDYKPLLINDLLLVLSPRLDHTWTVSFFSKAGQLPLVKPYLRSVQSHNNKSVNEALNHLLTEEEDYQDAMQHAAESRDAELAQKLLQWFLEEGKRECFAACLFTCYDLLRPDMVLELAWRHNLVDLAMPYFIQVMREYLSKVDKLDALESLRKQEEHVTEPAPLVFDFDGHE

SEQ ID NO: 154 - protein, 1675 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDKLDASESLRKEEEQATETQPIVYGQPQLMLTAGPSVAVPPQAPFGYGYTAPPYGQPQPGFGYSM

SEQ ID NO: 155 - protein, 1682 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPEAQNDFPVAMQISEKHDVVFLITKYGYIHLYDLETGTCIYMNRISGETIFVTAPHEATAGIIGVNRKGQVLSVCVEEENIIPYITNVLQNPDLALRMAVRNNLAGAEELFARKFNALFAQGNYSEAAKVAANAPKGILRTPDTIRRFQSVPAQPGQTSPLLQYFGILLDQGQLNKYESLELCRPVLQQGRKQLLEKWLKEDKLECSEELGDLVKSVDPTLALSVYLRANVPNKVIQCFAETGQVQKIVLYAKKVGYTPDWIFLLRNVMRISPDQGQQFAQMLVQDEEPLADITQIVDVFMEYNLIQQCTAFLLDALKNNRPSEGPLQTRLLEMNLMHAPQVADAILGNQMFTHYDRAHIAQLCEKAGLLQRALEHFTDLYDIKRAVVHTHLLNPEWLVNYFGSLSVEDSLECLRAMLSANIRQNLQICVQVASKYHEQLSTQSLIELFESFKSFEGLFYFLGSIVNFSQDPDVHFKYIQAACKTGQIKEVERICRESNCYDPERVKNFLKEAKLTDQLPLIIVCDRFDFVHDLVLYLYRNNLQKYIEIYVQKVNPSRLPVVIGGLLDVDCSEDVIKNLILVVRGQFSTDELVAEVEKRNRLKLLLPWLEARIHEGCEEPATHNALAKIYIDSNNNPERFLRENPYYDSRVVGKYCEKRDPHLACVAYERGQCDLELINVCNENSLFKSLSRYLVRRKDPELWGSVLLESNPYRRPLIDQVVQTALSETQDPEEVSVTVKAFMTADLPNELIELLEKIVLDNSVFSEHRNLQNLLILTAIKADRTRVMEYINRLDNYDAPDIANIAISNELFEEAFAIFRKFDVNTSAVQVLIEHIGNLDRAYEFAERCNEPAVWSQLAKAQLQKGMVKEAIDSYIKADDPSSYMEVVQAANTSGNWEELVKYLQMARKKARESYVETELIFALAKTNRLAELEEFINGPNNAHIQQVGDRCYDEKMYDAAKLLYNNVSNFGRLASTLVHLGEYQAAVDGARKANSTRTWKEVCFACVDGKEFRLAQMCGLHIVVHADELEELINYYQDRGYFEELITMLEAALGLERAHMGMFTELAILYSKFKPQKMREHLELFWSRVNIPKVLRAAEQAHLWAELVFLYDKYEEYDNAIITMMNHPTDAWKEGQFKDIITKVANVELYYRAIQFYLEFKPLLLNDLLMVLSPRLDHTRAVNYFSKVKQLPLVKPYLRSVQNHNNKSVNESLNNLFITEEDYQALRTSIDAYDNFDNISLAQRLEKHELIEFRRIAAYLFKGNNRWKQSVELCKKDSLYKDAMQYASESKDTELAEELLQWFLQEEKRECFGACLFTCYDLLRPDVVLETAWRHNIMDFAMPYFIQVMKEYLTKVDAIKEKVDKLDASESLRKEEEQATETQPIVYGQPQLMLTAGPSVAVPPQAPFGYGYTAPPYGQPQPGFGYSM

SEQ ID NO: 156 - protein, 2524 aa, Homo sapiens [sequence omitted]

SEQ ID NO: 157 - protein, 2105 aa, Homo sapiens
MMPSACGRPSLSWSVRRRSSNRRPNCCSSSLRRMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 158 - protein, 181 aa, Homo sapiens
SHSMRYFFTSVSRPGRGEPRFIAVGYVDDTQFVRFDSDAASQRMEPRAPWIEQEGPEYWDQETRNVKAQSQTDRVDLGTLRGYYNQSEAGSHTIQIMYGCDVGSDGRFLRGYRQDAYDGKDYIALNEDLRSWTAADMAAQITKRKWEAAHEAEQLRAYLDATCVEWLRRYLENGKETLQRT

SEQ ID NO: 159 - protein, 365 aa, Homo sapiens [sequence omitted]

SEQ ID NO: 160 - protein, 366 aa, Homo sapiens [sequence omitted]

SEQ ID NO: 161 - protein, 362 aa, Homo sapiens [sequence omitted]

SEQ ID NO: 162 - protein, 703 aa, Homo sapiens [sequence omitted]

SEQ ID NO: 163 - protein, 331 aa, Homo sapiens
MLVMAPRTVLLLLSAALALTETWAGSHSMRYFYTAMSRPGRGEPRFISVGYVDDTQFVRFDSDAASPREEPRAPWIEQEGPEYWDRNTQIFKTNTQTDRESLRNLRGYYNQSEAGSHTLQSMYGCDVGPDGRLLRGHNQYAYDGKDYIALNEDLRSWTAADTAAQITQRKWEAARVAEQERAYLEGTCVEWLRRYLENGKDTLERADPPKTHVTHHPISDHEATLRCWALGFYPAEITLTWQRDGEDQTQDTELVETRPAGDRTFQKWAAVVVPSGEEQRYTCHVQHEGLPKPLTLRWAVFPVHRPHRGHCCWPGCPSSCGHRSCGRCCDV

SEQ ID NO: 164 - protein, 362 aa, Homo sapiens [sequence omitted]

SEQ ID NO: 165 - protein, 362 aa, Homo sapiens [sequence omitted]

SEQ ID NO: 166 - protein, 541 aa, Homo sapiens
MLSPQRVAAAASRGADDAMESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQASSHIGNSTQATVRDAVVGRPSMDKKAQ

SEQ ID NO: 167 - protein, 495 aa, Homo sapiens
MESSKPGPVQVVLVQKDQHSFELDEKALASILLQDHIRDLDVVVVSVAGAFRKGKSFILDFMLRYLYSQKESGHSNWLGDPEEPLTGFSWRGGSDPETTGIQIWSEVFTVEKPGGKKVAVVLMDTQGAFDSQSTVKDCATIFALSTMTSSVQIYNLSQNIQEDDLQQLQLFTEYGRLAMDEIFQKPFQTLMFLVRDWSFPYEYSYGLQGGMAFLDKRLQVKEHQHEEIQNVRNHIHSCFSDVTCFLLPHPGLQVATSPDFDGKLKDIAGEFKEQLQALIPYVLNPSKLMEKEINGSKVTCRGLLEYFKAYIKIYQGEDLPHPKSMLQATAEANNLAAAASAKDIYYNNMEEVCGGEKPYLSPDILEEKHCEFKQLALDHFKKTKKMGGKDFSFRYQQELEEEIKELYENFCKHNGSKNVFSTFRTPAVLFTGIVALYIASGLTGFIGLEVVAQLFNCMVGLLLIALLTWGYIRYSGQYRELGGAIDFGAAYVLEQ

SEQ ID NO: 168 - protein, 983 aa, Homo sapiens
MTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 169 - protein, 1013 aa, Homo sapiens
MGDKKDDKDSPKKNKGKERRDLDDLKKEVAMTEHKMSVEEVCRKYNTDCVQGLTHSKAQEILARDGPNALTPPPTTPEWVKFCRQLFGGFSILLWIGAILCFLAYGIQAGTEDDPSGDNLYLGIVLAAVVIITGCFSYYQEAKSSKIMESFKNMVPQQALVIREGEKMQVNAEEVVVGDLVEIKGGDRVPADLRIISAHGCKVDNSSLTGESEPQTRSPDCTHDNPLETRNITFFSTNCVEGTARGVVVATGDRTVMGRIATLASGLEVGKTPIAIEIEHFIQLITGVAVFLGVSFFILSLILGYTWLEAVIFLIGIIVANVPEGLLATVTVCLTLTAKRMARKNCLVKNLEAVETLGSTSTICSDKTGTLTQNRMTVAHMWFDNQIHEADTTEDQSGTSFDKSSHTWVALSHIAGLCNRAVFKGGQDNIPVLKRDVAGDASESALLKCIELSSGSVKLMRERNKKVAEIPFNSTNKYQLSIHETEDPNDNRYLLVMKGAPERILDRCSTILLQGKEQPLDEEMKEAFQNAYLELGGLGERVLGFCHYYLPEEQFPKGFAFDCDDVNFTTDNLCFVGLMSMIDPPRAAVPDAVGKCRSAGIKVIMVTGDHPITAKAIAKGVGIISEGNETVEDIAARLNIPVSQVNPRDAKACVIHGTDLKDFTSEQIDEILQNHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLLFIMANIPLPLGTITILCIDLGTDMVPAISLAYEAAESDIMKRQPRNPRTDKLVNERLISMAYGQIGMIQALGGFFSYFVILAENGFLPGNLVGIRLNWDDRTVNDLEDSYGQQWTYEQRKVVEFTCHTAFFVSIVVVQWADLIICKTRRNSVFQQGMKNKILIFGLFEETALAAFLSYCPGMDVALRMYPLKPSWWFCAFPYSFLIFVYDEIRKLILRRNPGGWVEKETYY

SEQ ID NO: 170 - protein, 209 aa, Homo sapiens
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWRYFAGNLASGGAAGATSLCFVYPLDFARTRLAADVGKAGAEREFRGLGDCLVKIYKSDGIKGLYQGFNVSVQGIIIYRAAYFGIYDTAKGKFAVGLCFI

SEQ ID NO: 171 - protein, 176 aa, Homo sapiens
KDFLAGGVAAAISKTAVAPIERVKLLLQIFLGGVDKRTQFWRYFAGNLASGGAAGATSLCFVYPLDFARTRLAADVGKAGAEREFRGLGDCLVKIYKSDGIKGLYQGFNVSVQGIIIYRAAYFGIYDTAKGTLDCWRKIARDEGGKAFFKGAWSNVLRGMGGAFVLVLYDEIKKYT

SEQ ID NO: 172 - protein, 298 aa, Homo sapiens
MTDAAVSFAKDFLAGGVAAAISKTAVAPIERVKLLLQVQHASKQITADKQYKGIIDCVVRIPKEQGVLSFWRGNLANVIRYFPTQALNFAFKDKYKQIFLGGVDKRTQFWRYFAGNLASGGAAGATSLCFVYPLDFARTRLAADVGKAGAEREFRGLGDCLVKIYKSDGIKGLYQGFNVSVQGIIIYRAAYFGIYDTAKGMLPDPKNTHIVISWMIAQTVTAVAGLTSYPFDTVRRRMMMQSGRKGTDIMYTGTLDCWRKIARDEGGKAFFKGAWSNVLRGMGGAFVLVLYDEIKKYT

SEQ ID NO: 173 - protein, 1042 aa, Homo sapiens
MHQLFQKTPEIYSVELSGTKDIVKTDKGDGKEKYRGLKNNCLELKKKNHKEEFQKELHLDDHKLSNRELEEKYGTDIIMGLSSTRAAELLARDGPNSLTPPKQTPEIVKFLKQMVGGFSILLWVGAFLCWIAYGIQYSSDKSASLNNVYLGCVLGLVVILTGIFAYYQEAKSTNIMSSFNKMIPQQALVIRDSEKKTIPSEQLVVGDIVEVKGGDQIPADIRVLSSQGCRVDNSSLTGESEPQPRSSEFTHENPLETKNICFYSTTCLEGTVTGMVINTGDRTIIGHIASLASGVGNEKTPIAIEIEHFVHIVAGVAVSIGILFFIIAVSLKYQVLDSIIFLIGIIVANVPEGLLATVTVTLSLTAKRMAKKNCLVKNLEAVETLGSTSIICSDKTGTLTQNRMTVAHLWFDNQIFVADTSEDHSNQVFDQSSRTWASLSKIITLCNRAEFKPGQENVPIMKKAVIGDASETALLKFSEVILGDVMEIRKRNRKVAEIPFNSTNKFQLSIHEMDDPHGKRFLMVMKGAPERILEKCSTIMINGEEHPLDKSTAKTFHTAYMELGGLGERVLGFCHLYLPADEFPETYSFDIDAMNFPTSNLCFVGLLSMIDPPRSTVPDAVTKCRSAGIKVIMVTGDHPITAKAIAKSVGIISANSETVEDIAHRLNIAVEQVNKRDAKAAVVTGMELKDMSSEQLDEILANYQEIVFARTSPQQKLIIVEGCQRQDAVVAVTGDGVNDSPALKKADIGIAMGIAGSDAAKNAADMVLLDDNFASIVTGVEEGRLIFDNLKKTIAYSLTKNIAELCPFLIYIIVGLPLPIGTITILFIDLGTDIIPSIALAYEKAESDIMNRKPRHKNKDRLVNQPLAVYSYLHIGLMQALGAFLVYFTVYAQEGFLPRTLINLRVEWEKDYVNDLKDSYGQEWTRYQREYLEWTGYTAFFVGILVQQIADLIIRKTRRNSIFQQGLFRNKVIWVGITSQIIIGLILSYGLGSVTALSFTMLRAQYWFVAVPHAILIWVYDEVRKLFIRLYPGSWWDKNMYY

SEQ ID NO: 174 - protein, 292 aa, Homo sapiens
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYDAIWHFADNQLFVSGPNGTAGIFATYPSGHLDMINGFFDQFIGTASLIVCVLAIVDPYNNPVPRGLEAFTVGLVVLVIGTSMGFNSGYAVNPARDFGPRLFTALAGWGSAVFTTGQHWWWVPIVSPLLGSIAGVFVYQLMIGCHLEQPPPSNEEENVKLAHVKHKEQI

SEQ ID NO: 175 - protein, 162 aa, Homo sapiens
MGRQKELVSRCGEMLHIRYRLLRQALAECLGTLILVMFGCGSVAQVVLSRGTHGGFLTINLAFGFAVTLGILIAGQVSGAHLNPAVTFAMCFLAREPWIKLPIYTLAQTLGAFLGAGIVFGLYYGKHSPPCPPPLPPSLCSGPAGTRPFDDRRLGPAQAPGS

SEQ ID NO: 176 - protein, 905 aa, Homo sapiens
MLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 177 - protein, 1043 aa, Homo sapiens
MEAAHLLPAADVLRHFSVTAEGGLSPAQVTGARERYGPNELPSEEGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHACLYPGLLRTVSQAWSRQPLTTSWTPDHTGRNEPEVSAGNRVESPVCTSD

SEQ ID NO: 178 - protein, 1007 aa, Homo sapiens [sequence omitted]

SEQ ID NO: 179 - protein, 993 aa, Homo sapiens
MEAAHLLPAADVLRHFSVTAEGGLSPAQVTGARERYGPNGKSLWELVLEQFEDLLVRILLLAALVSFVLAWFEEGEETTTAFVEPLVIMLILVANAIVGVWQERNAESAIEALKEYEPEMGKVIRSDRKGVQRIRARDIVPGDIVEVAVGDKVPADLRLIEIKSTTLRVDQSILTGESVSVTKHTEAIPDPRAVNQDKKNMLFSGTNITSGKAVGVAVATGLHTELGKIRSQMAAVEPERTPLQRKLDEFGRQLSHAISVICVAVWVINIGHFADPAHGGSWLRGAVYYFKIAVALAVAAIPEGLPAVITTCLALGTRRMARKNAIVRSLPSVETLGCTSVICSDKTGTLTTNQMSVCRMFVVAEADAGSCLLHEFTISGTTYTPEGEVRQGDQPVRCGQFDGLVELATICALCNDSALDYNEAKGVYEKVGEATETALTCLVEKMNVFDTDLQALSRVERAGACNTVIKQLMRKEFTLEFSRDRKSMSVYCTPTRPHPTGQGSKMFVKGAPESVIERCSSVRVGSRTAPLTPTSREQILAKIRDWGSGSDTLRCLALATRDAPPRKEDMELDDCSKFVQYETDLTFVGCVGMLDPPRPEVAACITRCYQAGIRVVMITGDNKGTAVAICRRLGIFGDTEDVAGKAYTGREFDDLSPEQQRQACRTARCFARVEPAHKSRIVENLQSFNEITAMTGDGVNDAPALKKAEIGIAMGSGTAVAKSAAEMVLSDDNFASIVAAVEEGRAIYSNMKQFIRYLISSNVGEVVCIFLTAILGLPEALIPVQLLWVNLVTDGLPATALGFNPPDLDIMEKLPRSPREALISGWLFFRYLAIGVYVGLATVAAATWWFVYDAEGPHINFYQLRNFLKCSEDNPLFAGIDCEVFESRFPTTMALSVLVTIEMCNALNSVSENQSLLRMPPWMNPWLLVAVAMSMALHFLILLVPPLPLIFQVTPLSGRQWVVVLQISLPVILLDEALKYLSRNHMHEEMSQK

SEQ ID NO: 180 - protein, 361 aa, Homo sapiens
MFSSVAHLARANPFNTPHLQLVHDGLGDLRSSSPGPTGQPRRPRNLAAAAVEEYSCEFGSAKYYALCGFGGVLSCGLTHTAVVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 181 - protein, 362 aa, Homo sapiens
MFSSVAHLARANPFNTPHLQLVHDGLGDLRSSSPGPTGQPRRPRNLAAAAVEEQYSCDYGSGRFFILCGLGGIISCGTTHTALVPLDLVKCRMQVDPQKYKGIFNGFSVTLKEDGVRGLAKGWAPTFLGYSMQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 182 - protein, 231 aa, Homo sapiens
MQGLCKFGFYEVFKVLYSNMLGEENTYLWRTSLYLAASASAEFFADIALAPMEAAKVRIQTQPGYANTLRDAAPKMYKEEGLKAFYKGVAPLWMRQIPYTMMKFACFERTVEALYKFVVPKPRSECSKPEQLVVTFVAGYIAGVFCAIVSHPADSVVSVLNKEKGSSASLVLKRLGFKGVWKGLFARIIMIGTLTALQWFIYDSVKVYFRLPRPPPPEMPESLKKKLGLTQ

SEQ ID NO: 183 - protein, 249 aa, Homo sapiens [sequence omitted]

SEQ ID NO: 184 - protein, 757 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 185 - protein, 470 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPSLLIFVYDEVRKLIIRRRPGGWVEKETYY

SEQ ID NO: 186 - protein, 729 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 187 - protein, 992 aa, Homo sapiens
MDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 188 - protein, 1023 aa, Homo sapiens
MGKGVGRDKYEPAAVSEQGDKKGKKGKKDRDMDELKKEVSMDDHKLSLDELHRKYGTDLSRGLTSARAAEILARDGPNALTPPPTTPEWIKFCRQLFGGFSMLLWIGAILCFLAYSIQAATEEEPQNDNLYLGVVLSAVVIITGCFSYYQEAKSSKIMESFKNMVPQQALVIRNGEKMSINAEEVVVGDLVEVKGGDRIPADLRIISANGCKVDNSSLTGESEPQTRSPDFTNENPLETRNIAFFSTNCVEGTARGIVVYTGDRTVMGRIATLASGLEGGQTPIAAEIEHFIHIITGVAVFLGVSFFILSLILEYTWLEAVIFLIGIIVANVPEGLLATVTVCLTLTAKRMARKNCLVKNLEAVETLGSTSTICSDKTGTLTQNRMTVAHMWFDNQIHEADTTENQSGVSFDKTSATWLALSRIAGLCNRAVFQANQENLPILKRAVAGDASESALLKCIELCCGSVKEMRERYAKIVEIPFNSTNKYQLSIHKNPNTSEPQHLLVMKGAPERILDRCSSILLHGKEQPLDEELKDAFQNAYLELGGLGERVLGFCHLFLPDEQFPEGFQFDTDDVNFPIDNLCFVGLISMIDPPRAAVPDAVGKCRSAGIKVIMVTGDHPITAKAIAKGVGIISEGNETVEDIAARLNIPVSQVNPRDAKACVVHGSDLKDMTSEQLDDILKYHTEIVFARTSPQQKLIIVEGCQRQGAIVAVTGDGVNDSPALKKADIGVAMGIAGSDVSKQAADMILLDDNFASIVTGVEEGRLIFDNLKKSIAYTLTSNIPEITPFLIFIIANIPLPLGTVTILCIDLGTDMVPAISLAYEQAESDIMKRQPRNPKTDKLVNERLISMAYGQIGMIQALGGFFTYFVILAENGFLPIHLLGLRVDWDDRWINDVEDSYGQQWTYEQRKIVEFTCHTAFFVSIVVVQWADLVICKTRRNSVFQQGMKNKILIFGLFEETALAAFLSYCPGMGVALRMYPLKPTWWFCAFPYSLLIFVYDEVRKLIIRRRPGGWVEKETYY

SEQ ID NO: 189 - protein, 917 aa, Homo sapiens
MGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 190 - protein, 518 aa, Homo sapiens [sequence omitted]

SEQ ID NO: 191 - protein, 507 aa, Homo sapiens
MTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPGKECVQPATKSCSFSACTDGISWPFVLLIMPLVIWVYSTDTNFSDMFWS

SEQ ID NO: 192 - protein, 872 aa, Homo sapiens
MGKVYRQDRKSVQRIKAKDIVPGDIVEIAVGDKVPADIRLTSIKSTTLRVDQSILTGESVSVIKHTDPVPDPRAVNQDKKNMLFSGTNIAAGKAMGVVVATGVNTEIGKIRDEMVATEQERTPLQQKLDEFGEQLSKVISLICIAVWIINIGHFNDPVHGGSWIRGAIYYFKIAVALAVAAIPEGLPAVITTCLALGTRRMAKKNAIVRSLPSVETLGCTSVICSDKTGTLTTNQMSVCRMFILDRVEGDTCSLNEFTITGSTYAPIGEVHKDDKPVNCHQYDGLVELATICALCNDSALDYNEAKGVYEKVGEATETALTCLVEKMNVFDTELKGLSKIERANACNSVIKQLMKKEFTLEFSRDRKSMSVYCTPNKPSRTSMSKMFVKGAPEGVIDRCTHIRVGSTKVPMTSGVKQKIMSVIREWGSGSDTLRCLALATHDNPLRREEMHLEDSANFIKYETNLTFVGCVGMLDPPRIEVASSVKLCRQAGIRVIMITGDNKGTAVAICRRIGIFGQDEDVTSKAFTGREFDELNPSAQRDACLNARCFARVEPSHKSKIVEFLQSFDEITAMTGDGVNDAPALKKAEIGIAMGSGTAVAKTASEMVLADDNFSTIVAAVEEGRAIYNNMKQFIRYLISSNVGEVVCIFLTAALGFPEALIPVQLLWVNLVTDGLPATALGFNPPDLDIMNKPPRNPKEPLISGWLFFRYLAIGCYVGAATVGAAAWWFIAADGGPRVSFYQLSHFLQCKEDNPDFEGVDCAIFESPYPMTMALSVLVTIEMCNALNSLSENQSLLRMPPWENIWLVGSICLSMSLHFLILYVEPLPLIFQITPLNVTQWLMVLKISLPVILMDETLKFVARNYLEPAILE

SEQ ID NO: 193 - protein, 1009 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKVGAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGVSCLCPHPPSREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 194 - protein, 1020 aa, Homo sapiens
MGRGAGREYSPAATTAENGGGKKKQKEKELDELKKEVAMDDHKLSLDELGRKYQVDLSKGLTNQRAQDVLARDGPNALTPPPTTPEWVKFCRQLFGGFSILLWIGAILCFLAYGIQAAMEDEPSNDNLYLGVVLAAVVIVTGCFSYYQEAKSSKIMDSFKNMVPQQALVIREGEKMQINAEEVVVGDLVEVKGGDRVPADLRIISSHGCKVDNSSLTGESEPQTRSPEFTHENPLETRNICFFSTNCVEGTARGIVIATGDRTVMGRIATLASGLEVGRTPIAMEIEHFIQLITGVAVFLGVSFFVLSLILGYSWLEAVIFLIGIIVANVPEGLLATVTVCLTLTAKRMARKNCLVKNLEAVETLGSTSTICSDKTGTLTQNRMTVAHMWFDNQIHEADTTEDQSGATFDKRSPTWTALSRIAGLCNRAVFKAGQENISVSKRDTAGDASESALLKCIELSCGSVRKMRDRNPKVAEIPFNSTNKYQLSIHEREDSPQSHVLVMKGAPERILDRCSTILVQGKEIPLDKEMQDAFQNAYMELGGLGERVLGFCQLNLPSGKFPRGFKFDTDELNFPTEKLCFVGLMSMIDPPRAAVPDAVGKCRSAGIKVIMVTGDHPITAKAIAKGVGIISEGNETVEDIAARLNIPMSQVNPREAKACVVHGSDLKDMTSEQLDEILKNHTEIVFARTSPQQKLIIVEGCQRQGAIVAVTGDGVNDSPALKKADIGIAMGISGSDVSKQAADMILLDDNFASIVTGVEEGRLIFDNLKKSIAYTLTSNIPEITPFLLFIIANIPLPLGTVTILCIDLGTDMVPAISLAYEAAESDIMKRQPRNSQTDKLVNERLISMAYGQIGMIQALGGFFTYFVILAENGFLPSRLLGIRLDWDDRTMNDLEDSYGQEWTYEQRKVVEFTCHTAFFASIVVVQWADLIICKTRRNSVFQQGMKNKILIFGLLEETALAAFLSYCPGMGVALRMYPLKVTWWFCAFPYSLLIFIYDEVRKLILRRYPGGWVEKETYY

SEQ ID NO: 195 - protein, 663 aa, Homo sapiens
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPMDISNKASGEIKIAYTYSVSFEEDDKIRWASRWDYILESMPHTHIQWFSIMNSLVIVLFLSGMVAMIMLRTLHKDIARYNQMDSTEDAQEEFGWKLVHGDIFRPPRKGMLLSVFLGSGTQILIMTFVTLFFACLGFLSPANRGALMTCAVVLWVLLGTPAGYVAARFYKSFGGEKWKTNVLLTSFLCPGIVFADFFIMNLILWGEGSSAAIPFGTLVAILALWFCISVPLTFIGAYFGFKKNAIEHPVRTNQIPRQIPEQSFYTKPLPGIIMGGILPFGCIFIQLFFILNSIWSHQMYYMFGFLFLVFIILVITCSEATILLCYFHLCAEDYHWQWRSFLTSGFTAVYFLIYAVHYFFSKLQITGTASTILYFGYTMIMVLIFFLFTGTIGFFACFWFVTKIYSVVKVD

SEQ ID NO: 196 - protein, 283 aa, Homo sapiens
MEPPGDWGPPPWRSTPKTDVLRLVLYLTFLGAPCYAPALPSCKEDEYPVGSECCPKCSPGYRVKEACGELTGTVCEPCPPGTYIAHLNGLSKCLQCQMCDPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 197 - protein, 172 aa, Homo sapiens
MVSRPPRTPLSPSSWTPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQAKCGEINDVDDEAP

SEQ ID NO: 198 - protein, 199 aa, Homo sapiens
MVSRPPRTPLSPSSWTPAMGLRASRNCSRTENAVCGCSPGHFCIVQDGDHCAACRAYATSSPGQRVQKGGTESQDTLCQNCPPGTFSPNGTLEECQHQTKCSWLVTKAGAGTSSSHWVWWFLSGSLVIVIVCSTVGLIICVKRRKPRGDVVKVIVSVQRKRQEAEGEATVIEALQAPPDVTTVAVEETIPSFTGRSPNH

SEQ ID NO: 199 - protein, 960 aa, Homo sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMLAFLGENAEVKEMMTTWTLQKGIPLLVVKQDGCSLRLQQERFLQGVFQEDPEWRALQERYLWHIPLTYSTSSSNVIHRHILKSKTDTLDLPEKTSWVKFNVDSNGYYIVHYEGHGWDQLITQLNQNHTLLRPKDRVGLIHDVFQLVGAGRLTLDKALDMTYYLQHETSSPALLEGLSYLESFYHMMDRRNISDISENLKRYLLQYFKPVIDRQSWSDKGSVWDRMLRSALLKLACDLNHAPCIQKAAELFSQWMESSGKLNIPTDVLKIVYSVGAQTTAGWNYLLEQYELSMSSAEQNKILYALSTSKHQEKLLKLIELGMEGKVIKTQNLAALLHAIARRPKGQQLAWDFVRENWTHLLKKFDLGSYDIRMIISGTTAHFSSKDKLQEVKLFFESLEAQGSHLDIFQTVLETITKNIKWLEKNLPTLRTWLMVNT

SEQ ID NO: 200 - protein, 532 aa, Homo sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLDLIAIPDFAPGAMENWGLITYRETSLLFDPKTSSASDKLWVTRVIAHELAHQWFGNLVTMEWWNDIWLKEGFAKYMELIAVNATYPELQFDDYFLNVCFEVITKDSLNSSRPISKPAETPTQIQEMFDEVSYNKGACILNMLKDFLGEEKFQKGIIQYLKKFSYRNAKNDDLWSSLSNSCLESDFTSGGVCHSDPKMTSNMVRIKRVTE

SEQ ID NO: 201 - protein, 350 aa, Homo sapiens
MFHSSAMVNSHRKPMFNIHRGFYCLTAILPQICICSQFSVPSSYHFTEDPGAFPVATNGERFPWQELRLPSVVIPLHYDLFVHPNLTSLDFVASEKIEVLVSNATQFIILHSKDLEITNATLQSEEDSRYMKPGKELKVLSYPAHEQIALLVPEKLTPHLKYYVAMDFQAKLGDGFEGFYKSTYRTLGGETRILAVTDFEPTQARMAFPCFDEPLFKANFSIKIRRESRHIALSNMPKVKTIELEGGLLEDHFETTVKMSTYLVAYIVCDFHSLSGFTSSGVKVSIYASPDKRNQTHYALQASLKLLDFYEKYFDIYYPLSKLGMFKFHIIVFIFAHKTCFDLFPLSLSM

SEQ ID NO: 202 - protein, 152 aa, Homo sapiens
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVLGLIATCLFGYDAYVTFPVRQPRHTAAPTDPADGPV

SEQ ID NO: 203 - protein, 742 aa, Homo sapiens [sequence omitted]

SEQ ID NO: 204 - protein, 395 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 205 - protein, 493 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 206 - protein, 361 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 207 - protein, 535 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATSTSSNTISAGWEPNEENEDERDRHLSFSGSGIDDDEDFISSTNMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 208 - protein, 425 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATNMDSSHSITLQPTANPNTGLVEDLDRTGPLSMTTQQSNSQSFSTSHEGLEEDKDHPTTSTLTSSRDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 209 - protein, 691 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGGYIFYTFSTVHPIPDEDSPWITDSTDRIPATTLMSTSATATETATKRQETWDWFSWLFLPSESKNHLHTTTQMAAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 210 - protein, 668 aa, Homo sapiens
MDKFWWHAAWGLCLVPLSLAQIDLNITCRFAGVFHVEKNGRYSISRTEAADLCKAFNSTLPTMAQMEKALSIGFETCRYGFIEGHVVIPRIHPNSICAANNTGVYILTSNTSQYDTYCFNASAPPEEDCTSVTDLPNAFDGPITITIVNRDGTRYVQKGEYRTNPEDIYPSNPTDDDVSSGSSSERSSTSGALMSTSATATETATKRQETWDWFSWLFLPSESKNHLHTTTQMAGTSSNTISAGWEPNEENEDERDRHLSFSGSGIDDDEDFISSTISTTPRAFDHTKQNQDWTQWNPSHSNPEVLLQTTTRMTDVDRNGTTAYEGNWNPEAHPPLIHHEHHEEEETPHSTSTTASAHTSHPMQGRTTPSPEDSSWTDFFNPISHPMGRGHQAGRRMDMDSSHSITLQPTANPNTGLVEDLDRTGPLSMTTQQSNSQSFSTSHEGLEEDKDHPTTSTLTSSNRNDVTGGRRDPNHSEGSTTLLEGYTSHYPHTKESRTFIPVTSAKTGSFGVTAVTVGDSNSNVNRSLSGDQDTFHPSGGSHTTHGSESDGHSHGSQEGGANTTSGPIRTPQIPEWLIILASLLALALILAVCIAVNSRRRCGQKKKLVINSGNGAVEDRKPSGLNGEASKSQEMVHLVNKESSETPDQFMTADETRNLQNVDMKIGV

SEQ ID NO: 211 - protein, 193 aa, Homo sapiens
MPEEGSGCSVRRRPYGCVLRAALVPLVAGLVICLVVCIQRFAQAQQQLPLESLGWDVAELQLNHTGPQQDPRLYWQGGPALGRSFLHGPELDKGQLRIHRDGIYMVHIQVTLAICSSTTASRHHPTTLAVGICSPASRSISLLRLSFHQGCTIASQRLTPLARGDTLCTNLTGTLLPSRNTDETFFGVQWVRP

SEQ ID NO: 212 - protein, 1822 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 213 - protein, 1752 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 214 - protein, 1875 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTGCGWKFEPLLGEELDLRRVTWRLPPELIPRLSASSGRSSDAEAPHGPPDDGGAGGKGGSLPRSATPGPPGEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 215 - protein, 1702 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 216 - protein, 1805 aa, Homo sapiens
MAGPRPSPWARLLLAALISVSLSGTLANRCKKAPVKSCTECVRVDKDCAYCTDEMFRDRRCNTQAELLAAGCQRESIVVMESSFQITEETQIDTTLRRSQMSPQGLRVRLRPGEERHFELEVFEPLESPVDLYILMDFSNSMSDDLDNLKKMGQNLARVLSQLTSDYTIGFGKFVDKVSVPQTDMRPEKLKEPWPNSDPPFSFKNVISLTEDVDEFRNKLQGERISGNLDAPEGGFDAILQTAVCTRDIGWRPDSTHLLVFSTESAFHYEADGANVLAGIMSRNDERCHLDTTGTYTQYRTQDYPSVPTLVRLLAKHNIIPIFAVTNYSYSYYEKLHTYFPVSSLGVLQEDSSNIVELLEEAFNRIRSNLDIRALDSPRGLRTEVTSKMFQKTRTGSFHIRRGEVGIYQVQLRALEHVDGTHVCQLPEDQKGNIHLKPSFSDGLKMDAGIICDVCTCELQKEVRSARCSFNGDFVCGQCVCSEGWSGQTCNCSTGSLSDIQPCLREGEDKPCSGRGECQCGHCVCYGEGRYEGQFCEYDNFQCPRTSGFLCNDRGRCSMGQCVCEPGWTGPSCDCPLSNATCIDSNGGICNGRGHCECGRCHCHQQSLYTDTICEINYSAIHPGLCEDLRSCVQCQAWGTGEKKGRTCEECNFKVKMVDELKRAEEVVVRCSFRDEDDDCTYSYTMEGDGAPGPNSTVLVHKKKDCPPGSFWWLIPLLLLLLPLLALLLLLCWKYCACCKACLALLPCCNRGHMVGFKEDHYMLRENLMASDHLDTPMLRSGNLKGRDVVRWKVTNNMQRPGFATHAASINPTELVPYGLSLRLARLCTENLLKPDTRECAQLRQEVEENLNEVYRQISGVHKLQQTKFRQQPNAGKKQDHTIVDTVLMAPRSAKPALLKLTEKQVEQRAFHDLKVAPGYYTLTADQDARGMVEFQEGVELVDVRVPLFIRPEDDDEKQLLVEAIDVPAGTATLGRRLVNITIIKEQARDVVSFEQPEFSVSRGDQVARIPVIRRVLDGGKSQVSYRTQDGTAQGNRDYIPVEGELLFQPGEAWKELQVKLLELQEVDSLLRGRQVRRFHVQLSNPKFGAHLGQPHSTTIIIRDPDELDRSFTSQMLSSQPPPHGDLGAPQNPNAKAAGSRKIHFNWLPPSGKPMGYRVKYWIQGDSESEAHLLDSKVPSVELTNLYPYCDYEMKVCAYGAQGEGPYSSLVSCRTHQEVPSEPGRLAFNVVSSTVTQLSWAEPAETNGEITAYEVCYGLVNDDNRPIGPMKKVLVDNPKNRMLLIENLRESQPYRYTVKARNGAGWGPEREAIINLATQPKRPMSIPIIPDIPIVDAQSGEDYDSFLMYSDDVLRSPSGSQRPSVSDDTEHLVNGRMDFAFPGSTNSLHRMTTTSAAAYGTHLSPHVPHRVLSTSSTLTRDYNSLTRSEHSHSTTLPRDYSTLTSVSSHGLPPIWEHGRSRLPLSWALGSRSRAQMKGFPPSRGPRDSIILAGRPAAPSWGPDSRLTAGVPDTPTRLVFSALGPTSLRVSWQEPRCERPLQGYSVEYQLLNGGELHRLNIPNPAQTSVVVEDLLPNHSYVFRVRAQSQEGWGREREGVITIESQVHPQSPLCPLPGSAFTLSTPSAPGPLVFTALSPDSLQLSWERPRRPNGDIVGYLVTCEMAQGGGPATAFRVDGDSPESRLTVPGLSENVPYKFKVQARTTEGFGPEREGIITIESQDGGPFPQLGSRAGLFQHPLQSEYSSITTTHTSATEPFLVDGLTLGAQHLEAGGSLTRHVTQEFVSRTLTTSGTLSTHMDQQFFQT

SEQ ID NO: 217 - protein, 269 aa, Homo sapiens
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQTMSVIGGLLLVVALGPGGVSMDEKKKEW

SEQ ID NO: 218 - protein, 325 aa, Homo sapiens
MGQNDLMGTAEDFADQFLRVTKQYLPHVARLCLISTFLEDGIRMWFQWSEQRDYIDTTWNCGYLLASSFVFLNLLGQLTGCVLVLSRNFVQYACFGLFGIIALQTIAYSILWDLKFLMRNLALGGGLLLLLAESRSEGKSMFAGVPTMRESSPKQYMQLGGRVLLVLMFMTLLHFDASFFSIVQNIVGTALMILVAIGFKTKLAALTLVVWLFAINVYFNAFWTIPVYKPMHDFLKYDFFQSLPAWLRPVAVKDWFGVDSTKLPAFMYPLPFPSLGKGTDVLRTLFAETPENRWLSLLWSHSLASDPSVQASLAAGSLPHAEALE

SEQ ID NO: 219 - protein, 155 aa, Homo sapiens
MRGLSAEAARGWKRILGAARFCGQSQWESKEGLSCSGCCSSWLSSAIQVSHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 220 - protein, 128 aa, Homo sapiens
MGIQGGSVLFGLLLVLAVFCHSGHSLQCYNCPNPTADCKTAVNCSSDFDACLITKAGLQVYNKCWKFEHCNFNDVTTRLRENELTYYCCKKDLCNFNEQLENGGTSLSEKTVLLLVTPFLAAAWSLHP

SEQ ID NO: 221 - protein, 135 aa, Homo sapiens
MACGLVASNLNLKPGECLRVRGEVAPDAKSFVLNLGKDSNNLCLHFNPRFNAHGDANTIVCNSKDGGAWGTEQREAVFPFQPGSVAEVCITFDQANLTVKLPDGYEFKFPNRLNLEAINYMAADGDFKIKCVAFD

SEQ ID NO: 222 - protein, 375 aa, Homo sapiens
MDALQLANSAFAVDLFKQLCEKEPLGNVLFSPICLSTSLSLAQVGAKGDTANEIGQVLHFENVKDVPFGFQTVTSDVNKLSSFYSLKLIKRLYVDKSLNLSTEFISSTKRPYAKELETVDFKDKLEETKGQINNSIKDLTDGHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 223 - protein, 265 aa, Homo sapiens
MQRNWKLLTSKINWKKRKVRSTTQLRISQMASHFENILADNSVNDQTKILVVNAAYFVGKWMKKFSESETKECPFRVNKTDTKPVQMMNMEATFCMGNIDSINCKIIELPFQNKHLSMFILLPKDVEDESTGLEKIEKQLNSESLSQWTNPSTMANAKVKLSIPKFKVEKMIDPKACLENLGLKHIFSEDTSDFSGMSETKGVALSNVIHKVCLEITEDGGDSIEVPGARILQHKDELNADHPFIYIIRHNKTRNIIFFGKFCSP

SEQ ID NO: 224 - protein, 259 aa, Homo sapiens
MAPNIYLVRQRISRLGQRMSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 225 - protein, 241 aa, Homo sapiens
MSGFQINLNPLKEPLGFIKVLEWIASIFAFATCGGFKGQTEIQVNCPPAVTENKTVTATFGYPFRLNEASFQPPPGVNICDVNWKDYVLIGDYSSSAQFYVTFAVFVFLYCIAALLLYVGYTSLYLDSRKLPMIDFVVTLVATFLWLVSTSAWAKALTDIKIATGHNIIDELPPCKKKAVLCYFGSVTSMGSLNVSVIFGFLNMILWGGNAWFVYKETSLHSPSNTSAPHSQGGIPPPTGI

SEQ ID NO: 226 - protein, 526 aa, Homo sapiens
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 227 - protein, 528 aa, Homo sapiens
MRCALALSALLLLLSTPPLLPSSPSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTLTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 228 - protein, 115 aa, Homo sapiens
MPMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 229 - protein, 574 aa, Homo sapiens [sequence omitted]

SEQ ID NO: 230 - protein, 574 aa, Homo sapiens
MCPRAARAPATLLLALGAVLWPAAGAWELTILHTNDVHSRLEQTSEDSSKCVNASRCMGGVARLFTKVQQIRRAEPNVLLLDAGDQYQGTIWFTVYKGAEVAHFMNALRYDAMALGNHEFDNGVEGLIEPLLKEAKFPILSANIKAKGPLASQISGLYLPYKVLPVGDEVVGIVGYTSKETPFLSNPGTNLVFEDEITALQPEVDKLKTLNVNKIIALGHSGFEMDKLIAQKVRGVDVVVGGHSNTFLYTGNPPSKEVPAGKYPFIVTSDDGRKVPVVQAYAFGKYLGYLKIEFDERGNVISSHGNPILLNSSIPEDPSIKADINKWRIKLDNYSTQELGKTIVYLDGSSQSCRFRECNMGNLICDAMINNNLRHTDEMFWNHVSMCILNGGGIRSPIDERNNGTITWENLAAVLPFGGTFDLVQLKGSTLKKAFEHSVHRYGQSTGEFLQVGGIHVVYDLSRKPGDRVVKLDVLCTKCRVPSYDPLKMDEVYKVILPNFLANGGDGFQMIKDELLRHDSGDQDINVVSTYISKMKVIYPAVEGRIKFSTGSHCHGSFSLIFLSLWAVIFVLYQ

SEQ ID NO: 231 - protein, 238 aa, Homo sapiens
MAVEGGMKCVKFLLYVLLLAFCACAVGLIAVGVGAQLVLSQTIIQGATPGSLLPVVIIAVGVFLFLVAFVGCCGACKENYCLMITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 232 - protein, 1205 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 233 - protein, 1170 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYVAVAPVKSSPTTSVPAVSSPPMGNQSGQSVP

SEQ ID NO: 234 - protein, 1241 aa, Homo sapiens
MTNPSDRVLPANSMAESREGDFGCTVMELRKLMELRSRDALTQINVHYGGVQNLCSRLKTSPVEGLSGNPADLEKRRQVFGHNVIPPKKPKTFLELVWEALQDVTLIILEIAAIISLVLSFYRPAGEENELCGQVATTPEDENEAQAGWIEGAAILFSVIIVVLVTAFNDWSKEKQFRGLQCRIEQEQKFSIIRNGQLIQLPVAEIVVGDIAQVKYGDLLPADGILIQGNDLKIDESSLTGESDHVKKSLDKDPMLLSGTHVMEGSGRMVVTAVGVNSQTGIILTLLGVNEDDEGEKKKKGKKQGVPENRNKAKTQDGVALEIQPLNSQEGIDNEEKDKKAVKVPKKEKSVLQGKLTRLAVQIGKAGLLMSALTVFILILYFVIDNFVINRRPWLPECTPIYIQYFVKFFIIGITVLVVAVPEGLPLAVTISLAYSVKKMMKDNNLVRHLDACETMGNATAICSDKTGTLTMNRMTVVQAYIGGIHYRQIPSPDVFLPKVLDLIVNGISINSAYTSKILPPEKEGGLPRQVGNKTECALLGFVTDLKQDYQAVRNEVPEEKLYKVYTFNSVRKSMSTVIRNPNGGFRMYSKGASEIILRKCNRILDRKGEAVPFKNKDRDDMVRTVIEPMACDGLRTICIAYRDFDDTEPSWDNENEILTELTCIAVVGIEDPVRPEVPDAIAKCKQAGITVRMVTGDNINTARAIATKCGILTPGDDFLCLEGKEFNRLIRNEKGEVEQEKLDKIWPKLRVLARSSPTDKHTLVKGIIDSTVGEHRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLKRRPYGRNKPLISRTMMKNILGHAFYQLIVIFILVFAGEKFFDIDSGRKAPLHSPPSQHYTIVFNTFVLMQLFNEINSRKIHGEKNVFSGIYRNIIFCSVVLGTFICQIFIVEFGGKPFSCTSLSLSQWLWCLFIGIGELLWGQFISAIPTRSLKFLKEAGHGTTKEEITKDAEGLDEIDHAEMELRRGQILWFRGLNRIQTQIDVINTFQTGASFKGVLRRQNMGQHLDVKLVPSSSYIKVVKAFHSSLHESIQKPYNQKSIHSFMTHPEFAIEEELPRTPLLDEEEEENPDKASKFGTRVLLLDGEVTPYANTNNNAVDCNQVQLPQSDSSLQSLETSV

SEQ ID NO: 235 - protein, 1159 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 236 - protein, 1173 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQMEVVSTFKRSGSVQGAVRRRSSVLSQLHDVTNLSTPTHAILSAANPTSAAGNPGGESVP

SEQ ID NO: 237 - protein, 1220 aa, Homo sapiens
MGDMANSSIEFHPKPQQQRDVPQAGGFGCTLAELRTLMELRGAEALQKIEEAYGDVSGLCRRLKTSPTEGLADNTNDLEKRRQIYGQNFIPPKQPKTFLQLVWEALQDVTLIILEVAAIVSLGLSFYAPPGEESEACGNVSGGAEDEGEAEAGWIEGAAILLSVICVVLVTAFNDWSKEKQFRGLQSRIEQEQKFTVIRNGQLLQVPVAALVVGDIAQVKYGDLLPADGVLIQANDLKIDESSLTGESDHVRKSADKDPMLLSGTHVMEGSGRMVVTAVGVNSQTGIIFTLLGAGGEEEEKKDKKGKQQDGAMESSQTKAKKQDGAVAMEMQPLKSAEGGEMEEREKKKANAPKKEKSVLQGKLTKLAVQIGKAGLVMSAITVIILVLYFVIETFVVEGRTWLAECTPVYVQYFVKFFIIGVTVLVVAVPEGLPLAVTISLAYSVKKMMKDNNLVRHLDACETMGNATAICSDKTGTLTTNRMTVVQSYLGDTHYKEIPAPSALTPKILDLLVHAISINSAYTTKILPPEKEGALPRQVGNKTECALLGFVLDLKRDFQPVREQIPEDKLYKVYTFNSVRKSMSTVIRMPDGGFRLFSKGASEILLKKCTNILNSNGELRGFRPRDRDDMVRKIIEPMACDGLRTICIAYRDFSAGQEPDWDNENEVVGDLTCIAVVGIEDPVRPEVPEAIRKCQRAGITVRMVTGDNINTARAIAAKCGIIQPGEDFLCLEGKEFNRRIRNEKGEIEQERLDKVWPKLRVLARSSPTDKHTLVKGIIDSTTGEQRQVVAVTGDGTNDGPALKKADVGFAMGIAGTDVAKEASDIILTDDNFTSIVKAVMWGRNVYDSISKFLQFQLTVNVVAVIVAFTGACITQDSPLKAVQMLWVNLIMDTFASLALATEPPTESLLLRKPYGRDKPLISRTMMKNILGHAVYQLAIIFTLLFVGELFFDIDSGRNAPLHSPPSEHYTIIFNTFVMMQLFNEINARKIHGERNVFDGIFSNPIFCTIVLGTFGIQIVIVQFGGKPFSCSPLSTEQWLWCLFVGVGELVWGQVIATIPTSQLKCLKEAGHGPGKDEMTDEELAEGEEEIDHAERELRRGQILWFRGLNRIQTQIRVVKAFRSSLYEGLEKPESKTSIHNFMATPEFLINDYTHNIPLIDDTDVDENEERLRAPPPPSPNQNNNAIDSGIYLTTHVTKSATSSVFSSSPGSPLHSVETSL

SEQ ID NO: 238 - protein, 977 aa, Homo sapiens [sequence omitted]

SEQ ID NO: 239 - protein, 429 aa, Homo sapiens
MLPRLLLLICAPLCEPAELFLIASPSHPTEGSPVTLTCKMPFLQSSDAQFQFCFFRDTRALGPGWSSSPKLQIAAMWKEDTGSYWCEAQTMASKVLRSRRSQINVHRVPVADVSLETQPPGGQVMEGDRLVLICSVAMGTGDITFLWYKGAVGLNLQSKTQRSLTAEYEIPSVRESDAEQYYCVAENGYGPSPSGLVSITVRIPVSRPILMLRAPRAQAAVEDVLELHCEALRGSPPILYWFYHEDITLGSRSAPSGGGASFNLSLTEEHSGNYSCEANNGLGAQRSEAVTLNFTVPTGARSNHLTSGVIEGLLSTLGPATVALLFCYGLKRKIGRRSARDPLRSLPSPLPQEFTYLNSPTPGQLQPIYENVNVVSGDEVYSLAYYNQPEQESVAAETLGTHMEDKVSLDIYSRLRKANITDVDYEDAM

SEQ ID NO: 240 - protein, 759 aa, Homo sapiens [sequence omitted]

SEQ ID NO: 241 - protein, 592 aa, Homo sapiens [sequence omitted]

SEQ ID NO: 242 - protein, 987 aa, Homo sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGASHPLLDQRQPHYSAFGSVGEWLRAIKMGRYEESFAAAGFGSFELVSQISAEDLLRIGVTLAGHQKKILASVQHMKSQAKPGTPGGTGGPAPQY

SEQ ID NO: 243 - protein, 984 aa, Homo sapiens
MALDYLLLLLLASAVAAMEETLMDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 244 - protein, 976 aa, Homo sapiens
MELQAARACFALLWGCALAAAAAAQGKEVVLLDFAAAGGELGWLTHPYGKGWDLMQNIMNDMPIYMYSVCNVMSGDQDNWLRTNWVYRGEAERIFIELKFTVRDCNSFPGGASSCKETFNLYYAESDLDYGTNFQKRLFTKIDTIAPDEITVSSDFEARHVKLNVEERSVGPLTRKGFYLAFQDIGACVALLSVRVYYKKCPELLQGLAHFPETIAGSDAPSLATVAGTCVDHAVVPPGGEEPRMHCAVDGEWLVPIGQCLCQAGYEKVEDACQACSPGFFKFEASESPCLECPEHTLPSPEGATSCECEEGFFRAPQDPASMPCTRPPSAPHYLTAVGMGAKVELRWTPPQDSGGREDIVYSVTCEQCWPESGECGPCEASVRYSEPPHGLTRTSVTVSDLEPHMNYTFTVEARNGVSGLVTSRSFRTASVSINQTEPPKVRLEGRSTTSLSVSWSIPPPQQSRVWKYEVTYRKKGDSNSYNVRRTEGFSVTLDDLAPDTTYLVQVQALTQEGQGAGSKVHEFQTLSPEGSGNLAVIGGVAVGVVLLLVLAGVGFFIHRRRKNQRARQSPEDVYFSKSEQLKPLKTYVDPHTYEDPNQAVLKFTTEIHPSCVTRQKVIGAGEFGEVYKGMLKTSSGKKEVPVAIKTLKAGYTEKQRVDFLGEAGIMGQFSHHNIIRLEGVISKYKPMMIITEYMENGALDKFLREKDGEFSVLQLVGMLRGIAAGMKYLANMNYVHRDLAARNILVNSNLVCKVSDFGLSRVLEDDPEATYTTSGGKIPIRWTAPEAISYRKFTSASDVWSFGIVMWEVMTYGERPYWELSNHEVMKAINDGFRLPTPMDCPSAIYQLMMQCWQQERARRPKFADIVSILDKLIRAPDSLKTLADFDPRVSIRLPSTSGSEGVPFRTVSEWLESIKMQQYTEHFMAAGYTAIEKVVQMTNDDIKRIGVRLPGHQKRIAYSLLGLKDQVNTVGIPI

SEQ ID NO: 245 - protein, 1000 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHSMYTPKRAGTLGPFTVGSPIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 246 - protein, 998 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATGKMFEATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 247 - protein, 986 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 248 - protein, 956 aa, Homo sapiens
MDTKWVTSELAWTSHPESGWEEVSGYDEAMNPIRTYQVCNVRESSQNNWLRTGFIWRRDVQRVYVELKFTVRDCNSIPNIPGSCKETFNLFYYEADSDVASASSPFWMENPYVKVDTIAPDESFSRLDAGRVNTKVRSFGPLSKAGFYLAFQDQGACMSLISVRAFYKKCASTTAGFALFPETLTGAEPTSLVIAPGTCIPNAVEVSVPLKLYCNGDGEWMVPVGACTCATGHEPAAKESQCRPCPPGSYKAKQGEGPCLPCPPNSRTTSPAASICTCHNNFYRADSDSADSACTTVPSPPRGVISNVNETSLILEWSEPRDLGGRDDLLYNVICKKCHGAGGASACSRCDDNVEFVPRQLGLTERRVHISHLLAHTRYTFEVQAVNGVSGKSPLPPRYAAVNITTNQAAPSEVPTLRLHSSSGSSLTLSWAPPERPNGVILDYEMKYFEKSEGIASTVTSQMNSVQLDGLRPDARYVVQVRARTVAGYGQYSRPAEFETTSERGSGAQQLQEQLPLIVGSATAGLVFVVAVVVIAIVCLRKQRHGSDSEYTEKLQQYIAPGMKVYIDPFTYEDPNEAVREFAKEIDVSCVKIEEVIGAGEFGEVCRGRLKQPGRREVFVAIKTLKVGYTERQRRDFLSEASIMGQFDHPNIIRLEGVVTKSRPVMILTEFMENCALDSFLRLNDGQFTVIQLVGMLRGIAAGMKYLSEMNYVHRDLAARNILVNSNLVCKVSDFGLSRFLEDDPSDPTYTSSLGGKIPIRWTAPEAIAYRKFTSASDVWSYGIVMWEVMSYGERPYWDMSNQDVINAVEQDYRLPPPMDCPTALHQLMLDCWVRDRNLRPKFSQIVNTLDKLIRNAASLKVIASAQSGMSQPLLDRTVPDYTTFTTVGDWLDAIKMGRYKESFVSAGFASFDLVAQMTAEDLLRIGVTLAGHQKKILSSIQDMRLQMNQTLPVQV

SEQ ID NO: 249 - protein, 993 aa, Homo sapiens
MVFQTRYPSWIILCYIWLLRFAHTGEAQAAKEVLLLDSKAQQTELEWISSPPNGWEEISGLDENYTPIRTYQVCQVMEPNQNNWLRTNWISKGNAQRIFVELKFTLRDCNSLPGVLGTCKETFNLYYYETDYDTGRNIRENLYVKIDTIAADESFTQGDLGERKMKLNTEVREIGPLSKKGFYLAFQDVGACIALVSVKVYYKKCWSIIENLAIFPDTVTGSEFSSLVEVRGTCVSSAEEEAENAPRMHCSAEGEWLVPIGKCICKAGYQQKGDTCEPCGRGFYKSSSQDLQCSRCPTHSFSDKEGSSRCECEDGYYRAPSDPPYVACTRPPSAPQNLIFNINQTTVSLEWSPPADNGGRNDVTYRILCKRCSWEQGECVPCGSNIGYMPQQTGLEDNYVTVMDLLAHANYTFEVEAVNGVSDLSRSQRLFAAVSITTGQAAPSQVSGVMKERVLQRSVELSWQEPEHPNGVITEYEIKYYEKDQRERTYSTVKTKSTSASINNLKPGTVYVFQIRAFTAAGYGNYSPRLDVATLEEATATAVSSEQNPVIIIAVVAVAGTIILVFMVFGFIIGRRHCGYSKADQEGDEELYFHFKFPGTKTYIDPETYEDPNRAVHQFAKELDASCIKIERVIGAGEFGEVCSGRLKLPGKRDVAVAIKTLKVGYTEKQRRDFLCEASIMGQFDHPNVVHLEGVVTRGKPVMIVIEFMENGALDAFLRKHDGQFTVIQLVGMLRGIAAGMRYLADMGYVHRDLAARNILVNSNLVCKVSDFGLSRVIEDDPEAVYTTTGGKIPVRWTAPEAIQYRKFTSASDVWSYGIVMWEVMSYGERPYWDMSNQDVIKAIEEGYRLPAPMDCPAGLHQLMLDCWQKERAERPKFEQIVGILDKMIRNPNSLKTPLGTCSRPISPLLDQNTPDFTTFCSVGEWLQAIKMERYKDNFTAAGYNSLESVARMTIEDVMSLGITLVGHQKKIMSSIQTMRAQMLHLHGTGIQV

SEQ ID NO: 250 - protein, 935 aa, Homo sapiens
MELRVLLCWASLAAALEETLLNTKLETADLKWVTFPQVDGQWEELSGLDEEQHSVRTYEVCDVQRAPGQAHWLRTGWVPRRGAVHVYATLRFTMLECLSLPRAGRSCKETFTVFYYESDADTATALTPAWMENPYIKVDTVAAEHLTRKRPGAEATGKVNVKTLRLGPLSKAGFYLAFQDQGACMALLSLHLFYKKCAQLTVNLTRFPETVPRELVVPVAGSCVVDAVPAPGPSPSLYCREDGQWAEQPVTGCSCAPGFEAAEGNTKCRACAQGTFKPLSGEGSCQPCPANSHSNTIGSAVCQCRVGYFRARTDPRGAPCTTPPSAPRSVVSRLNGSSLHLEWSAPLESGGREDLTYALRCRECRPGGSCAPCGGDLTFDPGPRDLVEPWVVVRGLRPDFTYTFEVTALNGVSSLATGPVPFEPVNVTTDREVPPAVSDIRVTRSSPSSLSLAWAVPRAPSGAVLDYEVKYHEKGAEGPSSVRFLKTSENRAELRGLKRGASYLVQVRARSEAGYGPFGQEHHSQTQLDESEGWREQLALIAGTAVVGVVLVLVVIVVAVLCLRKQSNGREAEYSDKHGQYLIGHGTKVYIDPFTYEDPNEAVREFAKEIDVSYVKIEEVIGAGEFGEVCRGRLKAPGKKESCVAIKTLKGGYTERQRREFLSEASIMGQFEHPNIIRLEGVVTNSMPVMILTEFMENGALDSFLRLNDGQFTVIQLVGMLRGIASGMRYLAEMSYVHRDLAARNILVNSNLVCKVSDFGLSRFLEENSSDPTYTSSLGGKIPIRWTAPEAIAFRKFTSASDAWSYGIVMWEVMSFGERPYWDMSNQDVINAIEQDYRLPPPPDCPTSLHQLMLDCWQKDRNARPRFPQVVSALDKMIRNPASLKIVARENGGDLLRIGVTLAGHQKKILASVQHMKSQAKPGTPGGTGGPAPQY

SEQ ID NO: 251 - protein, 962 aa, Homo sapiens
MDTRTATAELGWTANPASGWEEVSGYDENLNTIRTYQVCNVFEPNQNNWLLTTFINRRGAHRIYTEMRFTVRDCSSLPNVPGSCKETFNLYYYETDSVIATKKSAFWSEAPYLKVDTIAADESFSQVDFGGRLMKVNTEVRSFGPLTRNGFYLAFQDYGACMSLLSVRVFFKKCPSIVQNFAVFPETMTGAESTSLVIARGTCIPNAEEVDVPIKLYCNGDGEWMVPIGRCTCKPGYEPENSVACKACPAGTFKASQEAEGCSHCPSNSRSPAEASPICTCRTGYYRADFDPPEVACTSVPSGPRNVISIVNETSIILEWHPPRETGGRDDVTYNIICKKCRADRRSCSRCDDNVEFVPRQLGLTECRVSISSLWAHTPYTFDIQAINGVSSKSPFPPQHVSVNITTNQAAPSTVPIMHQVSATMRSITLSWPQPEQPNGIILDYEIRYYEKEHNEFNSSMARSQTNTARIDGLRPGMVYVVQVRARTVAGYGKFSGKMCFQTLTDDDYKSELREQLPLIAGSAAAGVVFVVSLVAISIVCSRKRAYSKEAVYSDKLQHYSTGRGSPGMKIYIDPFTYEDPNEAVREFAKEIDVSFVKIEEVIGAGEFGEVYKGRLKLPGKREIYVAIKTLKAGYSEKQRRDFLSEASIMGQFDHPNIIRLEGVVTKSRPVMIITEFMENGALDSFLRQNDGQFTVIQLVGMLRGIAAGMKYLAEMNYVHRDLAARNILVNSNLVCKVSDFGLSRYLQDDTSDPTYTSSLGGKIPVRWTAPEAIAYRKFTSASDVWSYGIVMWEVMSFGERPYWDMSNQDVINAIEQDYRLPPPMDCPAALHQLMLDCWQKDRNSRPRFAEIVNTLDKMIRNPASLKTVATITAVPSQPLLDRSIPDFTAFTTVDDWLSAIKMVQYRDSFLTAGFTSLQLVTQMTSEDLLRIGITLAGHQKKILNSIHSMRVQISQSPTAMA

SEQ ID NO: 252 - protein, 987 aa, Homo sapiens [sequence omitted]

SEQ ID NO: 253 - protein, 334 aa, Homo sapiens
MKDSPFQVTKLYWLNEKWDFIASASDMAAEQGQILVIATAAVGGFTLLVILTLFFLITGRCQWYIKAKMKSEEKRRNHLQNGHLRFPGIKTYIDPDTYEDPSLAVHEFAKEIDPSRIRIERVIGAGEFGEVCSGRLKTPGKREIPVAIKTLKGGHMDRQRRDFLREASIMGQFDHPNIIRLEGVVTKRSFPAIGVEAFCPSFLRAGFLNSIQAPHPVPGGGSLPPRIPAGRPVMIVVEYMENGSLDSFLRKHDGHFTVIQLVGMLRGIASGMKYLSDMGYVHRDLAARNILVNSNLVCKVSDFGLSRVLEDDPEAAYTTTDLFQTLTLNLCYSA

SEQ ID NO: 254 - protein, 1055 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 255 - protein, 987 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEV

SEQ ID NO: 256 - protein, 1056 aa, Homo sapiens
MALRRLGAALLLLPLLAAVEETLMDSTTATAELGWMVHPPSGWEEVSGYDENMNTIRTYQVCNVFESSQNNWLRTKFIRRRGAHRIHVEMKFSVRDCSSIPSVPGSCKETFNLYYYEADFDSATKTFPNWMENPWVKVDTIAADESFSQVDLGGRVMKINTEVRSFGPVSRSGFYLAFQDYGGCMSLIAVRVFYRKCPRIIQNGAIFQETLSGAESTSLVAARGSCIANAEEVDVPIKLYCNGDGEWLVPIGRCMCKAGFEAVENGTVCRGCPSGTFKANQGDEACTHCPINSRTTSEGATNCVCRNGYYRADLDPLDMPCTTIPSAPQAVISSVNETSLMLEWTPPRDSGGREDLVYNIICKSCGSGRGACTRCGDNVQYAPRQLGLTEPRIYISDLLAHTQYTFEIQAVNGVTDQSPFSPQFASVNITTNQAAPSAVSIMHQVSRTVDSITLSWSQPDQPNGVILDYELQYYEKELSEYNATAIKSPTNTVTVQGLKAGAIYVFQVRARTVAGYGRYSGKMYFQTMTEAEYQTSIQEKLPLIIGSSAAGLVFLIAVVVIAIVCNRRRGFERADSEYTDKLQHYTSGHMTPGMKIYIDPFTYEDPNEAVREFAKEIDISCVKIEQVIGAGEFGEVCSGHLKLPGKREIFVAIKTLKSGYTEKQRRDFLSEASIMGQFDHPNVIHLEGVVTKSTPVMIITEFMENGSLDSFLRQNDGQFTVIQLVGMLRGIAAGMKYLADMNYVHRDLAARNILVNSNLVCKVSDFGLSRFLEDDTSDPTYTSALGGKIPIRWTAPEAIQYRKFTSASDVWSYGIVMWEVMSYGERPYWDMTNQDVINAIEQDYRLPPPMDCPSALHQLMLDCWQKDRNHRPKFGQIVNTLDKMIRNPNSLKAMAPLSSGINLPLLDRTIPDYTSFNTVDEWLEAIKMGQYKESFANAGFTSFDVVSQMMMEDILRVGVTLAGHQKKILNSIQVMRAQMNQIQSVEGQPLARRPRATGRTKRCQPRDVTKKTCNSNDGKKKGMGKKKTDPGRGREIQGIFFKEDSHKESNDCSCGG

SEQ ID NO: 257 - protein, 1139 aa, Homo sapiens [sequence omitted]

SEQ ID NO: 258 - protein, 1097 aa, Homo sapiens [sequence omitted]

SEQ ID NO: 259 - protein, 1769 aa, Homo sapiens
MILPNSPPNRTDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKCLSSMSTALSKMASPATVHLTEKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNIILPACDHLEHQGRYLGREKHHRRGNE

SEQ ID NO: 260 - protein, 2057 aa, Homo sapiens
MLRVIVESASNIPKTKFGKPDPIVSVIFKDEKKKTKKVDNELNPVWNEILEFDLRGIPLDFSSSLGIIVKDFETIGQNKLIGTATVALKDLTGDQSRSLPYKLISLLNEKGQDTGATIDLVIGYDPPSAPHPNDLSGPSVPGMGGDGEEDEGDEDRLDNAVRGPGPKGPVGTVSEAQLARRLTKVKNSRRMLSNKPQDFQIRVRVIEGRQLSGNNIRPVVKVHVCGQTHRTRIKRGNNPFFDELFFYNVNMTPSELMDEIISIRVYNSHSLRADCLMGEFKIDVGFVYDEPGHAVMRKWLLLNDPEDTSSGSKGYMKVSMFVLGTGDEPPPERRDRDNDSDDVESNLLLPAGIALRWVTFLLKIYRAEDIPQMDDAFSQTVKEIFGGNADKKNLVDPFVEVSFAGKKVCTNIIEKNANPEWNQVVNLQIKFPSVCEKIKLTIYDWDRLTKNDVVGTTYLHLSKIAASGGEVEDFSSSGTGAASYTVNTGETEVGFVPTFGPCYLNLYGSPREYTGFPDPYDELNTGKGEGVAYRGRILVELATFLEKTPPDKKLEPISNDDLLVVEKYQRRRKYSLSAVFHSATMLQDVGEAIQFEVSIGNYGNKFDTTCKPLASTTQYSRAVFDGNYYYYLPWAHTKPVVTLTSYWEDISHRLDAVNTLLAMAERLQTNIEALKSGIQGKIPANQLAELWLKLIDEVIEDTRYTLPLTEGKANVTVLDTQIRKLRSRSLSQIHEAAVRMRSEATDVKSTLAEIEDWLDKLMQLTEEPQNSMPDIIIWMIRGEKRLAYARIPAHQVLYSTSGENASGKYCGKTQTIFLKYPQEKNNGPKVPVELRVNIWLGLSAVEKKFNSFAEGTFTVFAEMYENQALMFGKWGTSGLVGRHKFSDVTGKIKLKREFFLPPKGWEWEGEWIVDPERSLLTEADAGHTEFTDEVYQNESRYPGGDWKPAEDTYTDANGDKAASPSELTCPPGWEWEDDAWSYDINRAVDEKGWEYGITIPPDHKPKSWVAAEKMYHTHRRRRLVRKRKKDLTQTASSTARAMEELQDQEGWEYASLIGWKFHWKQRSSDTFRRRRWRRKMAPSETHGAAAIFKLEGALGADTTEDGDEKSLEKQKHSATTVFGANTPIVSCNFDRVYIYHLRCYVYQARNLLALDKDSFSDPYAHICFLHRSKTTEIIHSTLNPTWDQTIIFDEVEIYGEPQTVLQNPPKVIMELFDNDQVGKDEFLGRSIFSPVVKLNSEMDITPKLLWHPVMNGDKACGDVLVTAELILRGKDGSNLPILPPQRAPNLYMVPQGIRPVVQLTAIEILAWGLRNMKNFQMASITSPSLVVECGGERVESVVIKNLKKTPNFPSSVLFMKVFLPKEELYMPPLVIKVIDHRQFGRKPVVGQCTIERLDRFRCDPYAGKEDIVPQLKASLLSAPPCRDIVIEMEDTKPLLASKEEEIVDWWSKFYASSGEHEKCGQYIQKGYSKLKIYNCELENVAEFEGLTDFSDTFKLYRGKSDENEDPSVVGEFKGSFRIYPLPDDPSVPAPPRQFRELPDSVPQECTVRIYIVRGLELQPQDNNGLCDPYIKITLGKKVIEDRDHYIPNTLNPVFGRMYELSCYLPQEKDLKISVYDYDTFTRDEKVGETIIDLENRFLSRFGSHCGIPEEYCVSGVNTWRDQLRPTQLLQNVARFKGFPQPILSEDGSRIRYGGRDYSLDEFEANKILHQHLGAPEERLALHILRTQGLVPEHVETRTLHSTFQPNISQGKLQMWVDVFPKSLGPPGPPFNITPRKAKKYYLRVIIWNTKDVILDEKSITGEEMSDIYVKGWIPGNEENKQKTDVHYRSLDGEGNFNWRFVFPFDYLPAEQLCIVAKKEHFWSIDQTEFRIPPRLIIQIWDNDKFSLDDYLGFLELDLRHTIIPAKSPEKCRLDMIPDLKAMNPLKAKTASLFEQKSMKGWWPCYAEKDGARVMAGKVEMTLEILNEKEADERPAGKGRDEPNMNPKLDLPNRPETSFLWFTNPCKTMKFIVWRRFKWVIIGLLFLLILLLFVAVLLYSLPNYLSMKIVKPNV

SEQ ID NO: 261 - protein, 139 aa, Homo sapiens
MDKFWWHAAWGLCLVPLSLAQIDLNITCRFAGVFHVEKNGRYSISRTEAADLCKAFNSTLPTMAQMEKALSIGFETCSLHCSQQSKKVWAEEKASDQQWQWSCGGQKAKWTQRRGQQVSGNGAFGEQGVVRNSRPVYDS

SEQ ID NO: 262 - protein, 554 aa, Homo sapiens [sequence omitted]

SEQ ID NO: 263 - protein, 770 aa, Homo sapiens
MRGVWPPPVSALLSALGMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 264 - protein, 767 aa, Homo sapiens
MEALRESVLHLALQMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 265 - protein, 758 aa, Homo sapiens
MPLQGLGLQRNPFLQGKRGPGLTSSPPLLPPSLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 266 - protein, 754 aa, Homo sapiens
MMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRAYQNWVKKNGAEHSLPTLGLTNNQLFFLGFAQVWCSVRTPESSHEGLITDPHSPSRFRVIGSLSNSKEFSEHFRCPPGSPMNPPHKCEVW

SEQ ID NO: 267 - protein, 735 aa, Homo sapiens
MEALRESVLHLALQMSTYKRATLDEEDLVDSLSEGDAYPNGLQVNFHSPRSGQRCWAARTQVEKRLVVLVVLLAAGLVACLAALGIQYQTRSPSVCLSEACVSVTSSILSSMDPTVDPCHDFFSYACGGWIKANPVPDGHSRWGTFSNLWEHNQAIIKHLLENSTASVSEAERKAQVYYRACMNETRIEELRAKPLMELIERLGGWNITGPWAKDNFQDTLQVVTAHYRTSPFFSVYVSADSKNSNSNVIQVDQSGLGLPSRDYYLNKTENEKVLTGYLNYMVQLGKLLGGGDEEAIRPQMQQILDFETALANITIPQEKRRDEELIYHKVTAAELQTLAPAINWLPFLNTIFYPVEINESEPIVVYDKEYLEQISTLINTTDRCLLNNYMIWNLVRKTSSFLDQRFQDADEKFMEVMYGTKKTCLPRWKFCVSDTENNLGFALGPMFVKATFAEDSKSIATEIILEIKKAFEESLSTLKWMDEETRKSAKEKADAIYNMIGYPNFIMDPKELDKVFNDYTAVPDLYFENAMRFFNFSWRVTADQLRKAPNRDQWSMTPPMVNAYYSPTKNEIVFPAGILQAPFYTRSSPKALNFGGIGVVVGHELTHAFDDQGREYDKDGNLRPWWKNSSVEAFKRQTECMVEQYSNYSVNGEPVNGRHTLGENIADNGGLKAAYRVWCSVRTPESSHEGLITDPHSPSRFRVIGSLSNSKEFSEHFRCPPGSPMNPPHKCEVW

SEQ ID NO: 268 - protein, 180 aa, Homo sapiens
MASTSYDYCRVPMEDGDKRCKLLLGIGILVLLIIVILGVPLIIFTIKANSEACRDGLRAVMECRNVTHLLQQELTEAQKGFQDVEAQAATCNHTVMALMASLDAEKAQGQKKVEELEGEITTLNHKLQDASAEVERLRRENQVLSVRIADKKYYPSSQDSSSAAAPQLLIVLLGLSALLQ

SEQ ID NO: 269 - protein, 158 aa, Homo sapiens
AVLCPPRYPKLAALNPESNTAEQDIFAKFSAYIKNSNPVVNDNLEKGLLKALKVLDNHLISCHSEEVDETSAEDEGISQRKFLDGNELTLADCNLLLTLHIVQVVCKKKKKYQGFTIPEAFQGVQQYLSNAYAQEESASTCPDDEIKLTYEQGSKALQ

SEQ ID NO: 270 - protein, 241 aa, Homo sapiens
MAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 271 - protein, 178 aa, Homo sapiens
MSGGKYVDSEGHLYTVPIREQGNIYKPNNKAMADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 272 - protein, 147 aa, Homo sapiens
MADELSEKQVYDAHTKEIDLVNRDPKHLNDDVVKIDFEDVIAEPEGTHSFDGIWKASFTTFTVTKYWFYRLLSALFGIPMALIWGIYFAILSFLHIWAVVPCIKSFLIEIQCISRVYSIYVHTVCDPLFEAVGKIFSNVRINLQKEI

SEQ ID NO: 273 - protein, 1025 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 274 - protein, 1091 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 275 - protein, 1073 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRNKKDHYDATYHKAEIHAQPSDKERLTSDA

SEQ ID NO: 276 - protein, 1130 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPANSYLGLLFLTSVSYTDPDQFVYKTRPPREQPDTFPDVMMNSYLGFSLDSGKGIVSKDEITFVSGAPRANHSGAVVLLKRDMKSAHLLPEHIFDGEGLASSFGYDVAVVDLNKDGWQDIVIGAPQYFDRDGEVGGAVYVYMNQQGRWNNVKPIRLNGTKDSMFGIAVKNIGDINQDGYPDIAVGAPYDDLGKVFIYHGSANGINTKPTQVLKGISPYFGYSIAGNMDLDRNSYPDVAVGSLSDSVTIFRSRPVINIQKTITVTPNRIDLRQKTACGAPSGICLQVKSCFEYTANPAGYNPSISIVGTLEAEKERRKSGLSSRVQFRNQGSEPKYTQELTLKRQKQKVCMEETLWLQDNIRDKLRPIPITASVEIQEPSSRRRVNSLPEVLPILNSDEPKTAHIDVHFLKEGCGDDNVCNSNLKLEYKFCTREGNQDKFSYLPIQKGVPELVLKDQKDIALEITVTNSPSNPRNPTKDGDDAHEAKLIATFPDTLTYSAYRELRAFPEKQLSCVANQNGSQADCELGNPFKRNSNVTFYLVLSTTEVTFDTPDLDINLKLETTSNQDNLAPITAKAKVVIELLLSVSGVAKPSQVYFGGTVVGEQAMKSEDEVGSLIEYEFRVINLGKPLTNLGTATLNIQWPKEISNGKWLLYLVKVESKGLEKVTCEPQKEINSLNLTESHNSRKKREITEKQIDDNRKFSLFAERKYQTLNCSVNVNCVNIRCPLRGLDSKASLILRSRLWNSTFLEEYSKLNYLDILMRAFIDVTAAAENIRLPNAGTQVRVTVFPSKTVAQYSGVPWWIILVAILAGILMLALLVFILWKCGFFKRSRYDDSVPRYHAVRIRKEEREIKDEKYIDNLEKKQWITKWNENESYS

SEQ ID NO: 277 - protein, 387 aa, Homo sapiens
MSTFFSDTAWICLAVPTVLCGTVFCKYKKSSGQLWSWMVCLAGLCAVCLLILSPFWGLILFSVSCFLMYTYLSGQELLPVDQKAVLVTGGDCGLGHALCKYLDELGFTVFAGVLNENGPGAEELRRTCSPRLSVLQMDITKPVQIKDAYSKVAAMLQDRGLWAVINNAGVLGFPTDGELLLMTDYKQCMAVNFFGTVEVTKTFLPLLRKSKGRLVNVSSMGGGAPMERLASYGSSKAAVTMFSSVMRLELSKWGIKVASIQPGGFLTNIAGTSDKWEKLEKDILDHLPAEVQEDYGQDYILAQRNFLLLINSLASKDFSPVLRDIQHAILAKSPFAYYTPGKGAYLWICLAHYLPIGIYDYFAKRHFGQDKPMPRALRMPNYKKKAT

SEQ ID NO: 278 - protein, 308 aa, Homo sapiens [sequence omitted]

SEQ ID NO: 279 - protein, 379 aa, Homo sapiens [sequence omitted]

SEQ ID NO: 280 - protein, 645 aa, Homo sapiens [sequence omitted]

SEQ ID NO: 281 - protein, 278 aa, Homo sapiens [sequence omitted]

SEQ ID NO: 282 - protein, 565 aa, Homo sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVTRPTSPSATCMPSLWSRCSSTPHTTQETMAM

SEQ ID NO: 283 - protein, 622 aa, Homo sapiens
MAAAPRAGRRRGQPLLALLLLLLAPLPPGAPPGADAYFPEERWSPESPLQAPRVLIALLARNAAHALPTTLGALERLRHPRERTALWVATDHNMDNTSTVLREWLVAVKSLYHSVEWRPAEEPRSYPDEEGPKHWSDSRYEHVMKLRQAALKSARDMWADYILFVDADNLILNPDTLSLLIAENKTVVAPMLDSRAAYSNFWCGMTSQGYYKRTPAYIPIRKRDRRGCFAVPMVHSTFLIDLRKAASRNLAFYPPHPDYTWSFDDIIVFAFSCKQAEVQMYVCNKEEYGFLPVPLRAHSTLQDEAESFMHVQLEVMVKHPPAEPSRFISAPTKTPDKMGFDEVFMINLRRRQDRRERMLRALQAQEIECRLVEAVDGKAMNTSQVEALGIQMLPGYRDPYHGRPLTKGELGCFLSHYNIWKEVVDRGLQKSLVFEDDLRFEIFFKRRLMNLMRDVEREGLDWDLIYVGRKRMQVEHPEKAVPRVRNLVEADYSYWTLAYVISLQGARKLLAAEPLSKMLPVDEFLPVMFDKHPVSEYKAHFSLRNLHAFSVEPLLIYPTHYTGDDGYVSDTETSVVWNNEHVKTDWDRAKSQKMREQQALSREAKNSDVLQSPLDSAARDEL

SEQ ID NO: 284 - protein, 956 aa, Homo sapiens
MRVNEKYSTLPAEDRSVHIINICAIEDIGYLPSEGTLLNSLSVDPDAECKYGLYFRDGRRKVDYILVYHHKRPSGNRTLVRRVQHSDTPSGARSVKQDHPLPGKGASLDAGSGEPPMDYHEDDKRFRREEYEGNLLEAGLELERDEDTKIHGVGFVKIHAPWNVLCREAEFLKLKMPTKKMYHINETRGLLKKINSVLQKITDPIQPKVAEHRPQTMKRLSYPFSREKQHLFDLSDKDSFFDSKTRSTIVYEILKRTTCTKAKYSMGITSLLANGVYAAAYPLHDGDYNGENVEFNDRKLLYEEWARYGVFYKYQPIDLVRKYFGEKIGLYFAWLGVYTQMLIPASIVGIIVFLYGCATMDENIPSMEMCDQRHNITMCPLCDKTCSYWKMSSACATARASHLFDNPATVFFSVFMALWAATFMEHWKRKQMRLNYRWDLTGFEEEEDHPRAEYEARVLEKSLKKESRNKETDKVKLTWRDRFPAYLTNLVSIIFMIAVTFAIVLGVIIYRISMAAALAMNSSPSVRSNIRVTVTATAVIINLVVIILLDEVYGCIARWLTKIEVPKTEKSFEERLIFKAFLLKFVNSYTPIFYVAFFKGRFVGRPGDYVYIFRSFRMEECAPGGCLMELCIQLSIIMLGKQLIQNNLFEIGIPKMKKLIRYLKLKQQSPPDHEECVKRKQRYEVDYNLEPFAGLTPEYMEMIIQFGFVTLFVASFPLAPLFALLNNIIEIRLDAKKFVTELRRPVAVRAKDIGIWYNILRGIGKLAVIINAFVISFTSDFIPRLVYLYMYSKNGTMHGFVNHTLSSFNVSDFQNGTAPNDPLDLGYEVQICRYKDYREPPWSENKYDISKDFWAVLAARLAFVIVFQNLVMFMSDFVDWVIPDIPKDISQQIHKEKVLMVELFMREEQDKQQLLETWMEKERQKDEPPCNHHNTKACPDSLGSPAPSHAYHGGVL

SEQ ID NO: 285 - protein, 31 aa, Homo sapiens
ASKCLAPSPKGAFPRWRHRLLSRMFGAREFV

SEQ ID NO: 286 - protein, 580 aa, Homo sapiens
MIISIDAEKAFDKIQQPFMLKTLNKLGIDGTYLKIIRAIYGKPTANIILNGQKLEAFPLKTGTRQGCPLSSLLFNIVLELLARAIRQEKEIKGIQLGKEEVKLSLFADGMIVYLANPIVSAQSLLKLISNFSKVSGYKINVQKSQAFLYANNRQTESQVMSELPFTIASKRIKYLGIELTRDVKDLFKENYKPLLNEIKEDTNKWKNIPCSWIGRINIVKMAILPKLGKNFLCINGKSRKEYKFLICHFQNCQAPQHFYELFRSSALSQSEDAEEELARKDGLEWTSKQTPADLQQRGLTVRRKTNKQKGIASTSTKRMSMQKPHPNVPNIKDQRIRKNYFKFHMEPKKAHIAKTILSKKNRAGGIKLPDFQLYYEATVIKTAWYWYQTRYIDQWNRTKASEITSHIYNHLIFDNPYKNKQWGKDFLFNKCCWENWLAMCRKLKLDPFFTPYTKINSRWNKDLKLRPKTIKTIEENLCNTIQDIGMGKDFMTKTPKAMATKAKIDKWVLIKLKIFCTAKETIAGSGQQPAMHWGSLFVPRWIGRSRNNRHTQDSESWVQGGNRLLVTWCRQCTGYTSIYY

SEQ ID NO: 287 - protein, 47 aa, Homo sapiens
EDLQEYLDPLQKWLRSEIRKLIKKEGKEKMRWKKSQQLCKKLTKRKF

SEQ ID NO: 288 - protein, 51 aa, Homo sapiens
AEGEGGEFLFVFGSLPCLTPGPSVWSHVLRYVCLVRVLVSIKSNCNISPNP

SEQ ID NO: 289 - DNA, 1852 bp, Homo sapiens
ttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagctttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgactta

SEQ ID NO: 290 - DNA, 2319 bp, Homo sapiens
ttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggcactacaaatactgtggcagcatataatttaacttggaaatcaactaatttcaagacaattttggagtgggaacccaaacccgtcaatcaagtctacactgttcaaataagcactaagtcaggagattggaaaagcaaatgcttttacacaacagacacagagtgtgacctcaccgacgagattgtgaaggatgtgaagcagacgtacttggcacgggtcttctcctacccggcagggaatgtggagagcaccggttctgctggggagcctctgtatgagaactccccagagttcacaccttacctggagacaaacctcggacagccaacaattcagagttttgaacaggtgggaacaaaagtgaatgtgaccgtagaagatgaacggactttagtcagaaggaacaacactttcctaagcctccgggatgtttttggcaaggacttaatttatacactttattattggaaatcttcaagttcaggaaagaaaacagccaaaacaaacactaatgagtttttgattgatgtggataaaggagaaaactactgtttcagtgttcaagcagtgattccctcccgaacagttaaccggaagagtacagacagcccggtagagtgtatgggccaggagaaaggggaattcagagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagctttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacaccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttgtacttattctatcttccatttattatttatgtacaatttggtgtttgtattagctctactacagtaaatgactgtaaaattgtcagtggcttacaacaacgtatctttttcgcttataatacattttggtgact

SEQ ID NO: 291 - DNA, 1651 bp, Homo sapiens
caccagcggccagaggtgagcagtcccgggaaggggccgagaggcggggccgccaggtcgggcaggtgtgcgctccgccccgccgcgcgcacagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttga

SEQ ID NO: 292 - DNA, 1606 bp, Homo sapiens
cgcgcgcgcagcatggcgcccccgcaggtcctcgcgttcgggcttctgcttgccgcggcgacggcgacttttgccgcagctcaggaaggtgaggcgcggattggagcagagttgtggagctgggctgggctggggggcagcggcccccggccctcggcccccgaaacgggcataatagggaggggaccaagaggccgcgctttccagcgtggagaccggacggtgcggccgtgctccggctcaggccctccgcgcggtaggaaacggcgagggccgtcccggggagcagcctcacttcgcagctttgctcgccttgaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaatttcttaactttga

SEQ ID NO: 293 - DNA, 1504 bp, Homo sapiens
gagcgagcaccttcgacgcggtccggggaccccctcgtcgctgtcctcccgacgcggacccgcgtgccccaggcctcgcgctgcccggccggctcctcgtgtcccactcccggcgcacgccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccacgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatggcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactg

SEQ ID NO: 294 - DNA, 4125 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaacccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaagctgg

SEQ ID NO: 295 - DNA, 4286 bp, Homo sapiens
caatcgcgaggcggcgggcgatcccgggctccccgggctgtgggctacaggcgcagagcgggccaggcgcggagctggcggcagtgacaggaggcgcgaacccgcagcgcttaccgcgcggcgccgcaccatggagcccgccgtgtcgctggccgtgtgcgcgctgctcttcctgctgtgggtgcgcctgaaggggctggagttcgtgctcatccaccagcgctgggtgttcgtgtgcctcttcctcctgccgctctcgcttatcttcgatatctactactacgtgcgcgcctgggtggtgttcaagctcagcagcgctccgcgcctgcacgagcagcgcgtgcgggacatccagaagcaggtgcgggaatggaaggagcagggtagcaagaccttcatgtgcacggggcgccctggctggctcactgtctcactacgtgtcgggaagtacaagaagacacacaaaaacatcatgatcaacctgatggacattctggaagtggacaccaagaaacagattgtccgtgtggagcccttggtgaccatgggccaggtgactgccctgctgacctccattggctggactctccccgtgttgcctgagcttgatgacctcacagtggggggcttgatcatgggcacaggcatcgagtcatcatcccacaagtacggcctgttccaacacatctgcactgcttacgagctggtcctggctgatggcagctttgtgcgatgcactccgtccgaaaactcagacctgttctatgccgtaccctggtcctgtgggacgctgggtttcctggtggccgctgagatccgcatcatccctgccaagaagtacgtcaagctgcgtttcgagccagtgcggggcctggaggctatctgtgccaagttcacccacgagtcccagcggcaggagaaccacttcgtggaagggctgctctactccctggatgaggctgtcattatgacaggggtcatgacagatgaggcagagcccagcaagctgaatagcattggcaattactacaagccgtggttctttaagcatgtggagaactatctgaagacaaaccgagagggcctggagtacattcccttgagacactactaccaccgccacacgcgcagcatcttctgggagctccaggacattatcccctttggcaacaaccccatcttccgctacctctttggctggatggtgcctcccaagatctccctcctgaagctgacccagggtgagaccctgcgcaagctgtacgagcagcaccacgtggtgcaggacatgctggtgcccatgaagtgcctgcagcaggccctgcacaccttccaaaacgacatccacgtctaccccatctggctgtgtccgttcatcctgcccagccagccaggcctagtgcaccccaaaggaaatgaggcagagctctacatcgacattggagcatatggggagccgcgtgtgaaacactttgaagccaggtcctgcatgaggcagctggagaagtttgtccgcagcgtgcatggcttccagatgctgtatgccgactgctacatgaaccgggaggagttctgggagatgtttgatggctccttgtaccacaagctgcgagagaagctgggttgccaggacgccttccccgaggtgtacgacaagatctgcaaggccgccaggcactgagctggagcccgcctggagagacagacacgtgtgagtggtcaggcatcttcccttcactcaagcttggctgctttcctagatccacactttcaaagagaaacccctccagaactcccaccctgacagcccaacaccaccttcctcctggcttccagggggcagcccagtggaatggaaagaatgtgggatttggagtcagacaagcctgagtccagttccccgtttagaactcattagctgtgtgactctgggtgagtcccttaacccctctgagcccgggtctcttcattagttgaaagggatagtaatacctacttgcaggttgttgtcatctgagttgagcactggtcacattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaagaaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagagatgccagcagcctctgtcgcccttagtcatataaccaaaatccagaccttatccacaacccggggcttggaaaggaaggtattttggaatcacaccctccggttatgttgctccagtaaaatcttgcctggaaagaggcagtcttcttagcatggtgagctgagttcatggcttttttttgtagccagtcctgtccctggccatccatgtgatggttttggatggagttaaacttgatgccagtgggcagtgcatgtggaaagtatcagagtaaggctctcccctccagagccctgagtttcttggctgcatgaaggttttctttagaatcagaattgtagccagtttctttggccagaaggatgaatacttggatattactgaaagggaggggtggagatgggtgtggcagtgtatggtgtgtgatttttattttcttctttggtcatgggggccaaggagaaaggcatgaatcttccctgtcaggctcttacagccacaggcactgtgtctactgtctggaagacatgtccccgtggctgtggggccgctgcttctgtttaaataaaagtggcctggaagctgg

SEQ ID NO: 296 - DNA, 1681 bp, Homo sapiens
aaatagcactgtaaaaagtgaactgttaaaactaaaggcacttaaaacaagaatgtgactagtgtgaaacaagatgggcaactcaaatggtgagaagtaaacatacagtggtctgttatggcactaactcaaagtaagactcgcgtaggtgagagctgttgcatagccacagtataacttcacatgttcattaaaaaggcaaattgaccgctaaaacttcaaagaaaaagtactcataaaaaaagtcttaccccaaaattgcaaacaaatacattaaaagattagaagaggtgacagaaagcaccagacattaaacaaaataaaaataataaaataaattcaactcaaaaggtccccattcagcaacagaaaattgctcggttcttttatctaaggcttgaatttgtaaagtgaaggcataaaagttaccaaacattaagtaactcttaaaatggcacacaggttttaaagctattggtttttccttcctaactctctgaatttttcccatggcctttgtagatcaactatttcaaacgtattttacaccagcaactctcaacatacttgtctttcagatatgtcatcagtcatgtctaacaggcaaatagcaaaataacagatttaaaacaatccttaactagctagcaggacatttactttggattctgcataactgcaaactgacatatttgtaaagctaaaaatcagttttaatacatgattaacagaaactctcatcatgctcattactttaactattgccctttcaatcgctatagaaatatcacttaatccaataagcttgatttcaatagtccaggaagaaaaggtcaaaaaggcacaatgtgaccttagctgacaagaataaccatcctgtctcaagtcttttgtcagtccctggcatgaattacaacattattttcaaaataataaaacattttaaaaattatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcaagtccaggagttttagac

SEQ ID NO: 297 - DNA, 3750 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 298 - DNA, 3876 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 299 - DNA, 3821 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 300 - DNA, 3768 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 301 - DNA, 3894 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 302 - DNA, 3839 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgtctctctctgtcgcccagcctggagtgcagtggtgtgatatcagctcactgcaacctctgacttccagattccagcaattctcctgcctcagcctcccgagtacctgggattacagggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 303 - DNA, 3788 bp, Homo sapiens
gagccagcccagccgcgttccgaacgtgagggtcgccggcctgggcgctgtcacgtcggggctgccggagctgcgggggaccgggcccgaacggcccctgacacctgcggtctcccgccgggctgggcaagcgcagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 304 - DNA, 3778 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 305 - DNA, 3405 bp, Homo sapiens
cagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaaacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 306 - DNA, 3852 bp, Homo sapiens
cagtttgatgtactaaaggcttctcgattgggagacaggaaacctgggtgtcagtgccgggtctgccactgaatttctgtgtgacctttgtcagagtactgtacttccagagcgttggtttccacatctaccctataaagcagcctgcatgtttctctcattctctcgttcgaggagttggaggatagctgctgcctgatatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 307 - DNA, 3670 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggatgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 308 - DNA, 3859 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 309 - DNA, 3733 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 310 - DNA, 3804 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 311 - DNA, 3762 bp, Homo sapiens
atgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggctt

SEQ ID NO: 312 - DNA, 3888 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacggtaagttacaaaacatccaaaaagcaaagtggcttataaagtaaatgtaatactcctaagacttatgtattagctgtcaggctgattattaaagtcctttctaagtattttattcccccaaaagtttcttactcaaggaatttgcatttagtgaaaaacagaaagcatcctaaatatatcccattgaaacaaaacattgattataagcatgtatattctggttactgtggccagtatttttatttctttaatagttttgatcctaaatctgccttttcatctaatgtgaagtagaatcctaaataatgttatctgtgtagcaagctattcaatggaaagctgcttctttctttaaaacaaacaaacaaaaaaaaccttcagtgaaagccagattcaaaaggttatataccaagcttgtccaactcgcagctcgtcggccaggacatgcagcccagaatagctttgaatgtggccccaacacaaatttgtaaactttcttagaaattgtaattattattattatttttttttggtaacttttttttaaagctcatcagctatcgttagtgtattttatgtgtggcccaagacaattcttcttcttccagtgtggcccagggaagccaaaagattggacacccctgctatatactatatgattccatttagaggacattctggaaaagcaaaactgtaggggcaaaaatcagtggttgctaggggctggaatgggggaaagtgttgaccacagaggggcgtaagggatcttccttgggatgatcttgattgtgggtggatttatgtatttgaaaactcacagaactatgtactttaaaaagatgtatgttcctctatgaaaattatatctcagtaaactttggcttataaaaatcttaaaagccctaagtgaccgaaaggttatgttagcattgagtgctttgaaatatggagtcagagggtggggtaaccaaatgttggcctttgtgtattcatcttttgatacaagaaagcaatgccaatcttcagtatttttaaattgtaaatgaattttgtagttagttgcactttactacaatttgcttgggtttttaaaaattatcaattttttaaattacaaatttcagaagggtagaaataaaaaaaaagacatttatagtgttcaaacactataaagggattttttttttctgatgaaatcattagaaactatttcttttactttagcaagaaaatccgatttacaagagtcctattaataatttcaagaatccaaactacggacgtaaagctggtctctaaattgccgttcgtattttgtttcactttctgcctttgcatgtgaacttctatcttttttactgcactgtgtgtcctttatcactattgctgttctttttttaagtctggctttaaatatcgctattgtggctt

SEQ ID NO: 313 - DNA, 3850 bp, Homo sapiens
agccgccgccacccgccgcgcccgacacccgggaggccccgccagcccgcgggagaggcccagcgggagtcgcggaacagcaggcccgagcccaccgcgccgggccccggacgccgcgcggaaaagatgaatttacaaccaattttctggattggactgatcagttcagtttgctgtgtgtttgctcaaacagattttctataagaagcatatgctggttttataatctcagaaaagatacgttggagacagtctgtattagcgcttaccatgtagaaggcatactcttccttagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattactcagatccaaccacagcagttggttttgcgattaagatcaggggagccacagacatttacattaaaattcaagagagctgaagactatcccattgacctctactaccttatggacctgtcttactcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccagcccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaagtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgcaagaaaatccgatttacaagagtcctattaataatttcaagaatccaaactacggacgtaaagctggtctctaaattgccggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacaaatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgttgctgaatggggaccttttgagttgaatttattttattatttttattttgtttaatgtctggtgctttctatcacctcttctaatcttttaatgtatttgtttgcaattttggggtaagactttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttcactttttacagtgctatttactgaagttatttattaaatatgcctaaaatacttaaatcggatgtcttgactctgatgtattttatcaggttgtgtgcatgaaatttttatagattaaagaagttgaggaaaagcattt

SEQ ID NO: 314 - DNA, 3614 bp, Homo sapiens
gtccgccaaaacctgcgcggatagggaagaacagcaccccggcgccgattgccgtaccaaacaagcctaacgtccgctgggccccggacgccgcgcggaaaagatgaatttacaaccaattttctggattggactgatcagttcagtttgctgtgtgtttgctcaaacagatgaaaatagatgtttaaaagcaaatgccaaatcatgtggagaatgtatacaagcagggccaaattgtgggtggtgcacaaattcaacatttttacaggaaggaatgcctacttctgcacgatgtgatgatttagaagccttaaaaaagaagggttgccctccagatgacatagaaaatcccagaggctccaaagatataaagaaaaataaaaatgtaaccaaccgtagcaaaggaacagcagagaagctcaagccagaggatattcatcagatccaaccacagcagttggttttgcgattaagatcaggggagccacagacatttacattaaaattcaagagagctgaagactatcccattgacctctactaccttatggacctgtcttattcaatgaaagacgatttggagaatgtaaaaagtcttggaacagatctgatgaatgaaatgaggaggattacttcggacttcagaattggatttggctcatttgtggaaaagactgtgatgccttacattagcacaacaccagctaagctcaggaacccttgcacaagtgaacagaactgcaccaccccatttagctacaaaaatgtgctcagtcttactaataaaggagaagtatttaatgaacttgttggaaaacagcgcatatctggaaatttggattctccagaaggtggtttcgatgccatcatgcaagttgcagtttgtggatcactgattggctggaggaatgttacacggctgctggtgttttccacagatgccgggtttcactttgctggagatgggaaacttggtggcattgttttaccaaatgatggacaatgtcacctggaaaataatatgtacacaatgagccattattatgattatccttctattgctcaccttgtccagaaactgagtgaaaataatattcagacaatttttgcagttactgaagaatttcagcctgtttacaaggagctgaaaaacttgatccctaagtcagcagtaggaacattatctgcaaattctagcaatgtaattcagttgatcattgatgcatacaattccctttcctcagaagtcattttggaaaacggcaaattgtcagaaggagtaacaataagttacaaatcttactgcaagaacggggtgaatggaacaggggaaaatggaagaaaatgttccaatatttccattggagatgaggttcaatttgaaattagcataacttcaaataagtgtccaaaaaaggattctgacagctttaaaattaggcctctgggctttacggaggaagtagaggttattcttcagtacatctgtgaatgtgaatgccaaagcgaaggcatccctgaaagtcccaagtgtcatgaaggaaatgggacatttgagtgtggcgcgtgcaggtgcaatgaagggcgtgttggtagacattgtgaatgcagcacagatgaagttaacagtgaagacatggatgcttactgcaggaaagaaaacagttcagaaatctgcagtaacaatggagagtgcgtctgcggacagtgtgtttgtaggaagagggataatacaaatgaaatttattctggcaaattctgcgagtgtgataatttcaactgtgatagatccaatggcttaatttgtggaggaaatggtgtttgcaagtgtcgtgtgtgtgagtgcaaccccaactacactggcagtgcatgtgactgttctttggatactagtacttgtgaagccagcaacggacagatctgcaatggccggggcatctgcgagtgtggtgtctgtaagtgtacagatccgaagtttcaagggcaaacgtgtgagatgtgtcagacctgccttggtgtctgtgctgagcataaagaatgtgttcagtgcagagccttcaataaaggagaaaagaaagacacatgcacacaggaatgttcctattttaacattaccaaggtagaaagtcgggacaaattaccccagccggtccaacctgatcctgtgtcccattgtaaggagaaggatgttgacgactgttggttctattttacgtattcagtgaatgggaacaacgaggtcatggttcatgttgtggagaatccagagtgtcccactggtccagacatcattccaattgtagctggtgtggttgctggaattgttcttattggccttgcattactgctgatatggaagcttttaatgataattcatgacagaagggagtttgctaaatttgaaaaggagaaaatgaatgccaaatgggacacgggtgaaaatcctatttataagagtgccgtaacaactgtggtcaatccgaagtatgagggaaaatgagtactgcccgtgcaaatcccacaacactgaatgcaaagtagcaatttccatagtcacagttaggtagctttagggcaatattgccatggttttactcatgtgcaggttttgaaaatgtacaatatgtataatttttaaaatgttttattattttgaaaataatgttgtaattcatgccagggactgacaaaagacttgagacaggatggttattcttgtcagctaaggtcacattgtgcctttttgaccttttcttcctggactattgaaatcaagcttattggattaagtgatatttctatagcgattgaaagggcaatagttaaagtaatgagcatgatgagagtttctgttaatcatgtattaaaactgatttttagctttacatatgtcagtttgcagttatgcagaatccaaagtaaatgtcctgctagctagttaaggattgttttaaatctgttattttgctatttgcctgttagacatgactgatgacatatctgaaagacaagtatgttgagagttgctggtgtaaaatacgtttgaaatagttgatctacaaaggccatgggaaaaattcagagagttaggaaggaaaaaccaatagctttaaaacctgtgtgccattttaagagttacttaatgtttggtaacttttatgccttcactttacaaattcaagccttagataaaagaaccgagcaattttctgctaaaaagtccttgatttagcactatttacatacaggccatactttacaaagtatttgctgaatggggaccttttgagttgaatttattttattatttttattttgtttaatgtctggtgctttctatcacctcttctaatcttttaatgtatttgtttgcaattttggggtaagacttttttatgagtactttttctttgaagttttagcggtcaatttgcctttttaatgaacatgtgaagttatactgtggctatgcaacagctctcacctacgcgagtcttactttgagttagtgccataacagaccactgtatgtttacttctcaccatttgagttgcccatcttgtttcacactagtcacattcttgttttaagtgcctttagttttaacagttca

SEQ ID NO: 315 - DNA, 1409 bp, Homo sapiens
gaatttctgggggcgcaccgccaagagctggggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagattttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 316 - DNA, 1982 bp, Homo sapiens
gaatttctgggggcgcaccgccaagagctggggatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 317 - DNA, 2143 bp, Homo sapiens
ggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaacgatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 318 - DNA, 1799 bp, Homo sapiens
ggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaacgatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 319 - DNA, 1866 bp, Homo sapiens
ggggaggggacgattaagttccctcagagaggaagccgcgggccgactggagtcgttttcgtgctctccgcacccgcccgccgcgggtagcatcttctcagcgccccggcgcccaggaacgcccaggaaacccagtcctcctcctaagcaacctgcggcgcggggacgcccgccttttgctattattataaacgatcgcagtatgtggtagggaagtgatgctgtctgaaggtgacatcctgttctcctctcttctgtcctctccatccttattttggccacctggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaataactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 320 - DNA, 1546 bp, Homo sapiens
gaatttctgggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 321 - DNA, 1858 bp, Homo sapiens
gtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagcttcaaagcaaacaacagttttgtgtaagcattctttcccctccagtattaggtgtattcttggtaggattatttgtgataatttgggctacttggctgagaaagttgtgcttcccatatgatctgtgttgcttcttgttttttcttaaggctattgtttattgttacttttctcctttttaaaaaaaaaaaaaggcagccgggcgcagtggctcacgcctgtagtcccagcactttgggaggccgaggcgggcggatcacaaggtcaagagatcgagaccatcctggccaa

SEQ ID NO: 322 - DNA, 1679 bp, Homo sapiens
atgacgaagaacgagaagaagtccctcaaccagagcctggccgagtggaagctcttcatctacaacccgaccaccggagaattcctggggcgcaccgccaagagctggggtttgatcttgctcttctacctagttttttatgggttcctggctgcactcttctcattcacgatgtgggttatgcttcagactctcaacgatgaggttccaaaataccgtgaccagattcctagcccaggactcatggtttttccaaaaccagtgaccgcattggaatatacattcagtaggtctgatccaacttcgtatgcagggtacattgaagaccttaagaagtttctaaaaccatatactttagaagaacagaagaacctcacagtctgtcctgatggagcactttttgaacagaagggtccagtttatgttgcatgtcagtttcctatttcattacttcaagcatgcagtggtatgaatgatcctgattttggctattctcaaggaaacccttgtattcttgtgaaaatgaacagaataattggattaaagcctgaaggagtgccaaggatagattgtgtttcaaagaatgaagatataccaaatgtagcagtttatcctcataatggaatgatagacttaaaatatttcccatattatgggaaaaaactgcatgttgggtatctacagccattggttgctgttcaggtcagctttgctcctaacaacactgggaaagaagtaacagttgagtgcaagattgatggatcagccaacctaaaaagtcaggatgatcgtgacaagtttttgggacgagttatgttcaaaatcacagcacgtgcatagtatgagtaggatatctccacagagtaaatgttgtgttgtctgtcttcattttgtaacagctggaccttccattctagaattatgagaccaccttggagaaaggtgtgtggtacatgacattgggttacatcataacgtgcttccagatcatagtgttcagtgtcctctgaagtaactgcctgttgcctctgctgccctttgaaccagtgtacagtcgccagatagggaccggtgaacacctgattccaaacatgtaggatgggggtcttgtcctctttttatgtggtttaattgccaagtgtctaaagcttaatatgccgtgctatgtaaatattttatggatataacaactgtcatattttgatgtcaacagagttttagggataaaatggtacccggccaacatcaagtgactttatagctgcaagaaatgtggtatgtggagaagttctgtatgtgaggaaggaaaaaaagaaaataaaagtgtgtttgaaaaatattatcttgggttctttgtaaaatttattttttacatgctgaattagcctcgatctttttgattaagagcacaaacttttttttgtaaaacatgtaaaaaaaaaaactgggattaatttttagtgttggaactgcctcttattttaggctgtagataaaatagcatttttaggttagccagtgtgactatgcacctaattttttatgagattaaattcataagacttaatttgtacaatagtttgtgaaatatcttgttactgcttttatttagcagactgtggactgtaataaagtatataaattgtgaaatataaaaacttggaacttattcaaagctt

SEQ ID NO: 323 - DNA, 3583 bp, Homo sapiens
ctcagttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctccgccagcttcgacggctgggccaccgtctcggtgatcgcgctctccaacatcctccactcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaaccaggaa

SEQ ID NO: 324 - DNA, 3583 bp, Homo sapiens; identical to SEQ ID NO: 323

SEQ ID NO: 325 - DNA, 2910 bp, Homo sapiens
ctcagttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaagccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcatagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatttccggggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccagcacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaagactataccttatccataggcgcaggtgcacagggggaggccataaagatcaaacatgcatggatgggtcctcacgcagacacacccacagaaggacactagcctgtgcacgcgcgcgtgcacacacacacacacacaagagttcataatgtggtgatggccctaagttaagcaaaatgcttctgcacacaaaactctctggtttacttcaaattaactctatttaaataaagtctctctgactttttgtgtcttcaaaaccaggaa

SEQ ID NO: 326 - DNA, 3990 bp, Homo sapiens
ggagcttccccagggagccagggggacttttgccgcagccatgaagggggcacgctggaggagggtcccctgggtgtccctgagctgcctgtgtctctgcctccttccgcatgtggtcccaggaatgacaacaccgtcactgaagacagacggtgggagacgcacagccacatcaccaccccccacaacctcccagaccatcatttccaccattcccagcactgccatgcacacccgctccacagctgcccccatccccatcctgcctgagagaggagtttccctcttcccctatggggcagacgccggggacctggagttcgtcaggaggaccgtggacttcacctccccactcttcaagccggcgactggcttcccccttggctcctctctccgtgattccctctacttcacagacaatggccagatcatcttcccagagtcagactaccagattttctcctaccccaacccactcccaacaggcttcacaggccgggaccctgtggccctggtggctccgttctgggacgatgctgacttctccactggtcgggggaccacattttatcaggaatacgagacgttctatggtgaacacagcctgctagtccagcaggccgagtcttggattagaaagatcacaaacaacgggggctacaaggccaggtgggccctaaaggtcacgtgggtcaatgcccacgcctatcctgcccagtggaccctcgggagcaacacctaccaagccatcctctccacggacgggagcaggtcctatgccctgtttctctaccagagcggtgggatgcagtgggacgtggcccagcgctcaggcaacccggtgctcatgggcttctctagtggagatggctatttcgaaaacagcccactgatgtcccagccagtgtgggagaggtatcgccctgatagattcctgaattccaactcaggcctccaagggctgcagttctacaggctacaccgggaagaaaggcccaactaccgtctcgagtgcctgcagtggctgaagagccagcctcggtggcccagctggggctggaaccaggtctcctgcccttgttcctggcagcagggacgacgggacttacgattccaacccgtcagcataggtcgctggggcctcggcagtaggcagctgtgcagcttcacctcttggcgaggaggcgtgtgctgcagctacgggccctggggagagtttcgtgaaggctggcacgtgcagcgtccttggcagttggcccaggaactggagccacagagctggtgctgccgctggaatgacaagccctacctctgtgccctgtaccagcagaggcggccccacgtgggctgtgctacatacaggcccccacagcccgcctggatgttcggggacccccacatcaccaccttggatggtgtcagttacaccttcaatgggctgggggacttcctgctggtcggggcccaagacgggaactcctccttcctgcttcagggccgcaccgcccagactggctcagcccaggccaccaacttcatcgcctttgcggctcagtaccgctccagcagcctgggccccgtcacggtccaatggctccttgagcctcacgacgcaatccgtgtcctgctggataaccagactgtgacatttcagcctgaccatgaagacggcggaggccaggagacgttcaacgccaccggagtcctcctgagccgcaacggctctgaggtctcggccagcttcgacggctgggccaccgtctcggtgatcgcgctctccaacatcctccacgcctccgccagcctcccgcccgagtaccagaaccgcacggaggggctcctgggggtctggaataacaatccagaggacgacttcaggatgcccaatggctccaccattcccccagggagccctgaggagatgcttttccactttggaatgacctggcagatcaacgggacaggcctccttggcaagaggaatgaccagctgccttccaacttcacccctgttttctactcacaactgcaaaaaaacagctcctgggctgaacatttgatctccaactgtgacggagatagctcatgcatctatgacaccctggccctgcgcaacgcaagcatcggacttcacacgagggaagtcagtaaaaactacgagcaggcgaacgccaccctcaatcagtacccgccctccatcaatggtggtcgtgtgattgaagcctacaaggggcagaccacgctgattcagtacaccagcaatgctgaggatgccaacttcacgctcagagacagctgcaccgacttggagctctttgagaatgggacgttgctgtggacacccaagtcgctggagccattcactctggagattctagcaagaagtgccaagattggcttggcatctgcactccagcccaggactgtggtctgccattgcaatgcagagagccagtgtttgtacaatcagaccagcagggtgggcaactcctccctggaggtggctggctgcaagtgtgacgggggcaccttcggccgctactgcgagggctccgaggatgcctgtgaggagccgtgcttcccgagtgtccactgcgttcctgggaagggctgcgaggcctgccctccaaacctgactggggatgggcggcactgtgcggctctggggagctctttcctgtgtcagaaccagtcctgccctgtgaattactgctacaatcaaggccactgctacatctcccagactctgggctgtcagcccatgtgcacctgccccccagccttcactgacagccgctgcttcctggctgggaacaacttcagtccaactgtcaacctagaacttcccttaagagtcatccagctcttgctcagtgaagaggaaaatgcctccatggcagaggtcaacgcctcggtggcatacagactggggaccctggacatgcgggcctttctccgcaacagccaagtggaacgaatcgattctgcagcaccggcctcgggaagccccatccaacactggatggtcatctcggagttccagtaccgccctcggggcccggtcattgacttcctgaacaaccagctgctggccgcggtggtggaggcgttcttataccacgttccacggaggagtgaggagcccaggaacgacgtggtcttccagcccatctccgaggaagacgtgcgcgatgtgacagccctgaacgtgagcacgctgaaggcttacttcagatgcgatggctacaagggctacgacctggtctacagcccccagagcggcttcacctgcgtgtccccgtgcagtaggggctactgtgaccatggaggccagtgccaacacctgcccagtgggccccgctgcagctgtgtgtccttctccatctacacggcctggggcgagcactgtgagcacctgagcatgaaactcgacgcgttcttcggcatcttctttggggccctgggcggcctcttgctgctgggggtcgggacgttcgtggtcctgcgcttctggggttgctccggggccaggttctcctatttcctgaactcagctgaggccttgccttgaaggggcagctgtggcctaggctacctcaagactcacctcatccttaccgcacatttaaggcgccattgcttttgggagactggaaaagggaaggtgactgaaggctgtcaggattcttcaaggagaatgaatactgggaatcaagacaggactataccttatccataggcgcaggtgcacagggggaggccataaagatcaaacatgcatggatgggtcctcacgcagacacacccacagaaggacactagcctggcgcgcgtgcacacacacacacacacacacgagttcataatgtggtgatggccctaagttaagcaaaatgcttctgcacacaaaactctctggtttacttcaaattaactctatttaaataaagtctctctgactttttgtgtctccaaaaaaaaaaaaaaaaa

SEQ ID NO: 327 - DNA, 3631 bp, Homo sapiens
gcttcccatacggcagtggctgggggagagtgatggagagaaaggctaagctaaggtcaaagaaagtggaggaaggctggcttgtcccgctggacttgacggcggagctgctgcaatctcgcgggctgggcccttgccccgggtggacccgagtgcctgcggggaggcgggtgtggctcccccgggaggtgacagctggcggggcccgtaaggagctggtctgctccggctcccctctcgtagccggcgccctgggaccagcgcgtgagcacgtctcggaggagtccgatgcgctgggcagggccgggtggtcacccccgcccagcttccaggggtgactgtgcctctgacgtcagacggtttttgggtcattccctggcacggggactttattttcataacagcatgaagtgccgtggaactggaataggcgtgtcctctccctcgaccctccccctccttgtccctctgctcacccctcgctcgttccctccctccggcgagggccgcctttataacaactgctcagagtgcgagggcgggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaata

SEQ ID NO: 328 - DNA, 2297 bp, Homo sapiens
atagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagggctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggataggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactcaaaaaaaaaaaaaaaaaaa

SEQ ID NO: 329 - DNA, 1098 bp, Homo sapiens
atggccagtacagagtcctccctgttgagatccctaggcctcagcccaggtcctggcagcagtgaggtggagctggactgttggtttgatgaggatttcaagttcatcctgctgcctgtgagctatgcagttgtctttgtgctgggcttgggccttaacgccccaaccctatggctcttcatcttccgcctccgaccctgggatgcaacggccacctacatgttccacctggcattgtcagacaccttgtatgtgctgtcgctgcccaccctcatctactattatgcagcccacaaccactggccctttggcactgagatctgcaagttcgtccgctttcttttctattggaacctctactgcagtgtccttttcctcacctgcatcagcgtgcaccgctacctgggcatctgccacccacttcgggcactacgctggggccgccctcgcctcgcaggccttctctgcctggcagtttggttggtcgtagccggctgcctcgtgcccaacctgttctttgtcacaaccagcaacaaagggaccaccgtcctgtgccatgacaccactcggcctgaagagtttgaccactatgtgcacttcagctcggcggtcatggggctgctctttggcgtgccctgcctggtcactcttgtttgctatggactcatggctcgtcgcctgtatcagcccttgccaggctctgcacagtcgtcttctcgcctccgctctctccgcaccatagctgtggtgctgactgtctttgctgtctgcttcgtgcctttccacatcacccgcaccatttactacctggccaggctgttggaagctgactgccgagtactgaacattgtcaacgtggtctataaagtgactcggcccctggccagtgccaacagctgcctggatcctgtgctctacttgctcactggggacaaatatcgacgtcagctccgtcagctctgtggtggtggcaagccccagccccgcacggctgcctcttccctggcactagtgtccctgcctgaggatagcagctgcaggtgggcggccaccccccaggacagtagctgctctactcctagggcagatagattgtaa

SEQ ID NO: 330 - DNA, 2665 bp, Homo sapiens
ggccccagcggactcccgggctccggtgctcggggctcggggcttgggcgtcgccggcgagcgcatgcccttccctgaagcgcggcctcttggcctggagctgggaccagttaggtaacggccccaggggcccgcagtggagagtgagcggggctttccctgccgggccagcccggcgcgctcgcccctggctgggcaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtcgttaatgaaaaaggatggaactacattcttgagaaatatgatgggcatcttccaatagaaataaaagctgttcctgaaggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcatttggttaacttcaaaggaacagatacagtagcaggacttgctctaaataaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcaatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttaacaagagatctcttgaattgttccttcaagtgtagctatgttgtaactaatggccttgggattaacgtcttcaaggacccggttgctgatcccaacaaaaggtccaaaaagggccgattatctttacataggacgccagcagggaattttgttacactggaagaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtgtgtaatacataatgtttattgtacagatgtgtggggtttgtgttttatgacacattacagccaaattatttgttggtttatggacatactgccctttcattttttttcttttccagtgtttaggtgatctcaaattaggaaatgcatttaactatgtaaaagattagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgcacaatttgaaaattatgtcgggacataccctatagaattactaaccttactgccccttgtagaatatgtattaatcattctacattaaagaaaataatggttcttactggaatgtctaggcactgtacagttattatatgtcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggcatgacttaaatgaattactggagtgggtagtgagtgtacttatcttaaatgtttcaattctgttatattttttattaagttttttaaaaattaaattgatattaaattgtaaaa

SEQ ID NO: 331 - DNA, 1658 bp, Homo sapiens
ggccccagcggactcccgggctccggtgctcggggctcggggcttgggcgtcgccggcgagcgcatgcccttccctgaagcgcggcctcttggcctggagctgggaccagttaggtaacggccccaggggcccgcagtggagagtgagcggggctttccctgccgggccagcccggcgcgctcgcccctggctgggcaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtcgttaatgaaaaaggatggaactacattcttgagaaatatgatgggcatcttccaatagaaataaaagctgttcctgaaggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcatttggttaacttcaaaggaacagatacagtagcaggacttgctctaaataaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcaatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttaacaagagatctcttgaattgttccttcaagtgtagctatgttgtaactaatggccttgggattaacgtcttcaaggacccggttgctgatcccaacaaaaggtccaaaaagggccgattatctttacataggacgccagcagggaattttgttacactggaagaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtgtgtgtgtgcat

SEQ ID NO: 332 - DNA, 4315 bp, Homo sapiens
ccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagt

SEQ ID NO: 333 - DNA, 4387 bp, Homo sapiens
gtcaggaggatcaggagggacaagagggatggaggcgaaaggctggatccttaatccaggccggagacaaagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagt

SEQ ID NO: 334 - DNA, 4327 bp, Homo sapiens
gtcaggaggatcaggagggacaagagggatggaggcgaaaggctggatccttaatccaggccggagacaaagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagct

SEQ ID NO: 335 - DNA, 4516 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagct

SEQ ID NO: 336 - DNA, 4576 bp, Homo sapiens
gctgccgcgccccgccctttctcggcccccggagggtgacggggtgaaggcgggggaaccgaggtggggagtccgccagagctcccagactgcgagcacgcgagccgccgcagccgtcacccgcgccgcgtcacggctcccgggcccgccctcctctgacccctcccctctctccgtttccccctctccccctcctccgccgaccgagcagtgacttaagcaacggagcgcggtgaagctcatttttctccttcctcgcagccgcgccagggagctcgcggcgcgcggcccctgtcctccggcccgagatgaatcctgcggcagaagccgagttcaacatcctcctggccaccgactcctacaaggttactcactataaacaatatccacccaacacaagcaaagtttattcctactttgaatgccgtgaaaagaagacagaaaactccaaattaaggaaggtgaaatatgaggaaacagtattttatgggttgcagtacattcttaataagtacttaaaaggtaaagtagtaaccaaagagaaaatccaggaagccaaagatgtctacaaagaacatttccaagatgatgtctttaatgaaaagggatggaactacattcttgagaagtatgatgggcatcttccaatagaaataaaagctgttcctgagggctttgtcattcccagaggaaatgttctcttcacggtggaaaacacagatccagagtgttactggcttacaaattggattgagactattcttgttcagtcctggtatccaatcacagtggccacaaattctagagagcagaagaaaatattggccaaatatttgttagaaacttctggtaacttagatggtctggaatacaagttacatgattttggctacagaggagtctcttcccaagagactgctggcataggagcatctgctcacttggttaacttcaaaggaacagatacagtagcaggacttgctctaattaaaaaatattatggaacgaaagatcctgttccaggctattctgttccagcagcagaacacagtaccataacagcttgggggaaagaccatgaaaaagatgcttttgaacatattgtaacacagttttcatcagtgcctgtatctgtggtcagcgatagctatgacatttataatgcgtgtgagaaaatatggggtgaagatctaagacatttaatagtatcgagaagtacacaggcaccactaataatcagacctgattctggaaaccctcttgacactgtgttaaaggttttggagattttaggtaagaagtttcctgttactgagaactcaaagggttacaagttgctgccaccttatcttagagttattcaaggggatggagtagatattaataccttacaagagattgtagaaggcatgaaacaaaaaatgtggagtattgaaaatattgccttcggttctggtggaggtttgctacagaagttgacaagagatctcttgaattgttccttcaagtgtagctatgttgtaactaatggccttgggattaacgtcttcaaggacccagttgctgatcccaacaaaaggtccaaaaagggccgattatctttacataggacgccagcagggaattttgttacactggaggaaggaaaaggagaccttgaggaatatggtcaggatcttctccatactgtcttcaagaatggcaaggtgacaaaaagctattcatttgatgaaataagaaaaaatgcacagctgaatattgaactggaagcagcacatcattaggctttatgactgggtgtgtgttgtgtgtatgtaatacataatgtttattgtacagatgtgtggggtttgtgttttatgatacattacagccaaattatttgttggtttatggacatactgccctttcattttttttcttttccagtgtttaggtgatctcaaattaggaaatgcatttaaccatgtaaaagatgagtgctaaagtaagctttttagggccctttgccaataggtagtcattcaatctggtattgatcttttcacaaataacagaactgagaaacttttatatataactgatgatcacataaaacagatttgcataaaattaccatgattgctttatgtttatatttaacttgtatttttgtacaaacaagattgtgtaagatatatttgaagtttcagtgatttaacagtctttccaacttttcatgatttttatgagcacagactttcaagaaaatacttgaaaataaattacattgccttttgtccattaatcagcaaataaaacatggccttaacaaagttgtttgtgttattgtacaatttgaaaattatgtcgggacataccctatagaattactaaccttactgccccttgtagaatatgtattaatcattctacattaaagaaaataatggttcttactggaatgtctaggcactgtacagttattatatatcttggttgttgtattgtaccagtgaaatgccaaatttgaaaggcctgtactgcaattttatatgtcagagattgcctgtggctctaatatgcacctcaagattttaaggagataatgtttttagagagaatttctgcttccactatagaatatatacataaatgtaaaatacttacaaaagtggaagtagtgtattttaaagtaattacacttctgaatttatttttcatattctatagttggtatgacttaaatgaattactggagtgggtagtgagtgtacttaaatgtttcaattctgttatattttttattaagtttttaaaaaattaaattggatattaaattgtatggacatcatttattaattttaaactgaatgccctcaataagtaatactgaagcacattcttaaatgaagataaattatctccaatgaaaagcatgacatgtgtttcaatagaagaatcttaagttggctaaattcaaagtgcttgacatcaaaatgttctagagtgattagctactagattctgaatcatacatcacatctgactagagaccagtttctttcgaatgattcttttatgtatgtagatctgttcttctgaggcagcggttggccaactatagcccaaaggccaaatttggacttctttttataaatgcagattgtctatggctgctttcccactactccagcctaaggtaaacagctgcaatagaagccaaatgagaatcgcaaagcccaaaatgtttattaacctgccctttacacaaaattacacaaaaagtttcctgatctctgttctaagaaaaggagtgtgccttgcatttaaaaggaaatgttggtttctagggaagggaggaggctaaataattgatacggaattttcctcttttgtcttcttttttctcacttaagaatccgatactggaagactgatttagaaaagtttttaacatgacattaaatgtgaaattttaaaaattgaaaagccataaatcatctgttttaaatagttacatgagaaaatgatcactagaataacctaattagaagtgttatcttcattaaatgttttttgtaagtggtattagaaagaatatgtttttcagatggttctttaaacatgtagtgagaacaataagcattattcacttttagtaagtcttctgtaatccatgatataaaataattttaaaatgattttttaatgtatttgagtaaagatgagtagtattaagaaaaacacacatttcttcacaaaatgtgctaaggggcgtgtaaagaatcaaaagaaactattaccaataatagttttgataatcacccataattttgtgtttaaacattgaaattatagtacagacagtattctctgtgttctgtgaatttcagcagcttcagaatagagtttaatttagaaatttgcagtgaaaaaagctatctctttgttcacaaccataaatcaggagatggagattaattctattggctcttagtcacttggaactgattaattctgactttctgtcactaagcacttggtatttggccatctccattctgagcaccaaacggttaacacgaatgtccactagaactctgctgtgtgtcacccttaaatcagtctaaatcttccagacaaaagcaaatggcatttatggatttaagtcattagattttcaactgacattaattaatccctcttgattgattatatcatcaagtatttatatcttaaataggaggtaggatttctgtgttaagactcttatttgtaccctataattaaagtaaaatgttttttatgagtatcccttgttttcccttcttaaattgttatcaaacaatttttataatgaaatctatcttggaaaattagaaagaaaaatggcaaggtatttattgttctgtttgccataatttagaactcacacttaagtattttgtagttttacattcctttttaacccattcagtggagaatgtcagcttttctcccaagttgtatgttaagtctattctaatatgtactcaacatcaagttataaacatgtaataaacatggaaataaagtttagctctattagtgaagt

SEQ ID NO: 337 - DNA, 2972 bp, Homo sapiens
cgaggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 338 - DNA, 2714 bp, Homo sapiens
ctctgcgccgggggagctagagtgtgtgttgtcttgcgagttgtaaggaaaagtgcctttttactgtttccacgccggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 339 - DNA, 2835 bp, Homo sapiens
cgaggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagatggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgatta

SEQ ID NO: 340 - DNA, 2847 bp, Homo sapiens
cgaggggccaaccccggcctaggctctccaccgcatcggattctggaatttacgatcacgaaagttctattgtcccgcgattggctcccgggccgcatgacatcatagcgcttgattcatccttcgggtcccgattggctggccgcgccattgtgacgtcacggtcagcccacgttctgattgtagatagccggcgccttcctcttcccatcgcgcgggtcctagccaccggtgtctccttctacatccgcctctgcgccggctgccacccgcgctccctccgccgccgccgccttgctgctgctcaaagctgctgccgccccttgggctaaaaggttttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaatttgcagatgtctttacatatttcaatacagaaactataacattcaatagtgtgctgtcaaagtgtgcttagctcacctggatatacctacattgttaaatgtctaaacagtaatcattaaaacatttttgattacctgtg

SEQ ID NO: 341 - DNA, 903 bp, Homo sapiens
tttcaaatggaacattttgatgcatcacttagtacctatttcaaggcattgctaggccctcgagatactagagtaaaaggatggtttcttctggacaattatatacccacatttatctgctctgtcatatatttactaattgtatggctgggaccaaaatacatgaggaataaacagccattctcttgccgggggattttagtggtgtataaccttggactcacactgctgtctctgtatatgttctgtgagttagtaacaggagtatgggaaggcaaatacaacttcttctgtcagggcacacgcaccgcaggagaatcagatatgaagattatccgtgtcctctggtggtactacttctccaaactcatagaatttatggacactttcttcttcatcctgcgcaagaacaaccaccagatcacggtcctgcacgtctaccaccatgcctcgatgctgaacatctggtggtttgtgatgaactgggtcccctgcggccactcttattttggtgccacacttaatagcttcatccacgtcctcatgtactcttactatggtttgtcgtcagtcccttccatgcgtccatacctctggtggaagaagtacatcactcaggggcagctgcttcagtttgtgctgacaatcatccagaccagctgcggggtcatctggccgtgcacattccctcttggttggttgtatttccagattggatacatgatttccctgattgctctcttcacaaacttctacattcagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggat

SEQ ID NO: 342 - DNA, 2279 bp, Homo sapiens
ttggacctagcttggcgcggaatccgtgaattgcccgcggcccgagggtgcaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggc

SEQ ID NO: 343 - DNA, 1926 bp, Homo sapiens
gactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggc

SEQ ID NO: 344 - DNA, 1556 bp, Homo sapiens
tccttcttaaaaaaaaccagggctccagagaatcagaacagccaccatcaccgcagggagtcaagggaggagggagattagagaaggagccagggagggtggcagggaggccacgtgatccgagtcccctcacccctttccttcccacaggtccctggccaaagatttatttctcttgacaaccaagggcctccgtctggatttccaaggaagaatttcctctgaagcaccggaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggagtcggc

SEQ ID NO: 345 - DNA, 2207 bp, Homo sapiens
ttggacctagcttggcgcggaatccgtgaattgcccgcggcccgagggtgcaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggtgagaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 346 - DNA, 2219 bp, Homo sapiens
ttggacctagcttggcgcggaatccgtgaattgcccgcggcccgagggtgcaggcctcctctagcccgtggaatccaaccccggctcctgtcagcagccctcccctgctgctccccatccctgccatcgtcttcatcgctgtgggcatctatttgttgctgctgggtctagtcctgctgactaggaactgcctgctggcccagggctgctgcgcggacggtagctccccctgcaggaagcaaggttcctccgggcccccagactgctgctggacctgtgcagaagcctgcaactttcctctgcctagcccggcccacttcctggatgcttgctgcccccagcccaccagagctgactgggcacctcgctgcccccgctgctgcccactctgcgactgtgcctgtacgtgccagctccccgactgccagagcctcaactgtctctgcttcgagatcaagctccgatgaggacccagggcccctgccctctggggagcggccagcccccagggcccatgtgccctcctccctgaagagcctttccccacgccactggaaccacagatggcctgccgagcacccaggcctgggaactggaagtggcagcgcagggcctggctccctgcagggcaggactcttggccggctggacggcagctcctctggagggccagaaaagagaggggctagtgctcgggcaggtgccctggcttcccttcccctccacacgtcaacgattctatttgaagttgggcaggggggtggcgctgctcaccacacacaagtgttataggaggagtctggcccttgagtaccgggtacgcaggggtgcctcaaccacactccgtccacggactctccgttattttaggaggtccctggccaaagatttatttctcttgacaaccaagggcctccgtctggatttccaaggaagaatttcctctgaagcaccggtgagaacttgctactaccagcaccatgccctaccaatatccagcactgaccccggagcagaagaaggagctgtctgacatcgctcaccgcatcgtggcacctggcaagggcatcctggctgcagatgagtccactgggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctggcttgcccgcgctctttcttccctcgtgacagtggtgtgtggtgtcgtctgtgaatgctaagtccatcaccctttccggcacactgccaaataaacagctatttaaggggga

SEQ ID NO: 347 - DNA, 903 bp, Homo sapiens
  misc_feature (1)...(903): n = A,T,C or G
gccgaccccggccccacgggcggacactcggccgggcagccgcgggccgagcgcagcgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagyctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaatccatgtaaataaaaaaaaaaaaaaaaangggcggccgtttta

SEQ ID NO: 348 - DNA, 892 bp, Homo sapiens
cccgggccgaccccggccccacgggcggacactcggccgggcagccgcgggccgagcgcagccgcctccgccaccgatgcgcctggtggccagactccaagtgggaccggcggacacgcagcctcgcgtgtcaggggaagctgatggagaatcgagctctggatccagggactcgggactcctatggtgccaccagccacctccccaacaagggggccctggcgaaggtcaagaacaacttcaaagacttgatgtccaaactgacggagggccagtatgtgctgtgccggtggacagatggcctgtactacctcgggaagatcaagagggtcagcagctctaagcaaagctgcctcgtgactttcgaagataattccaaatactgggtcctatggaaggacatacagcatgccggtgttccaggagaggagcccaagtgcaacatctgcctagggaagacatcagggccgctgaatgagatcctcatctgcgggaagtgtggcctgggttaccaccagcagtgccacatccccatagcgggcagtgctgaccagcccctgctcacaccttggttctgccgacgctgcatcttcgcactggctgtgcgggtgagccttccatcctccccagtccctgcctctcctgcctcctccagtggggcagaccagagactcccatcacagagcctgagctccaagcagaagggccacacctgggctttggagacagatagcgcctctgccactgtccttggccaggatttgtagactccctgagcctcagtttcctcaactgtaaagtggagatgggtttggtgtcgggaataacgggaccaataaatgatgctttactattaaaaaagaaaatccatgtaaaaaaaaaaaaaaaaaaa

SEQ ID NO: 349 - DNA, 1021 bp, Homo sapiens
ggcacgagggtgggcatcaaggtagacaagggcgtggtccccctggcagggacaaatggcgagactaccacccaagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcagaatggcattgtgcccatcgtggagcctgagatcctccctgatggggaccatgacttgaagcgctgccagtatgtgaccgagaaggtgctggctgctgtctacaaggctctgagtgaccaccacatctacctggaaggcaccttgctgaagcccaacatggtcaccccaggccatgcttgcactcagaagttttctcatgaggagattgccatggcgaccgtcacagcgctgcgccgcacagtgccccccgctgtcactgggatcaccttcctgtctggaggccagagtgaggaggaggcgtccatcaacctcaatgccattaacaagtgccccctgctgaagccctgggccctgaccttctcctacggccgagccctgcaggcctctgccctgaaggcctggggcgggaagaaggagaacctgaaggctgcgcaggaggagtatgtcaagcgagccctggccaacagccttgcctgtcaaggaaagtacactccgagcggtcaggctggggctgctgccagcgagtccctcttcgtctctaaccacgcctattaagcggaggtgttcccaggctgcccccaacactccaggccctgccccctcccactcttgaagaggaggccgcctcctcggggctccaggctggcttgcccgcgctctttcttccctcgtgacagtggtgtgtggtgtcgtctgtgaatgctaagtccatcaccctttccggcacactgccaaataaacagctatttaagggggaaaaaaaaaaaaaaaaaaaaaaaaaaaa

SEQ ID NO: 350 - DNA, 2111 bp, Homo sapiens
aggcccagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcgcggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattcttaatgtacacagtaaaaaactatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaa

SEQ ID NO: 351 - DNA, 2843 bp, Homo sapiens
aggcccagcggcgagctggctttctcctggccacttgccggggtgaggggcagccggaggagtccgagaggaagcggaggcgcgagctggaggcggcggctcccgtcggcctccggcaggactgagcgctgggaggccggaaggcgggcgcgcgcggcggagaggcgggcgggaggccggagcatattaatgaaaagtgccataaactgaaaaaccaaacatgagggtagcaggtgctgcaaagttggtggtagctgtggcagtgtttttactgacattttatgttatttctcaagtatttgaaataaaaatggatgcaagtttaggaaatctatttgcaagatcagcattggacacagctgcacgttctacaaagcctcccagatataagtgtgggatctcaaaagcttgccctgagaagcattttgcttttaaaatggcaagtggagcagccaacgtggtgggacccaaaatctgcctggaagataatgttttaatgagtggtgttaagaataatgttggaagagggatcaatgttgccttggcaaatggaaaaacaggagaagtattagacactaaatattttgacatgtggggaggagatgtggcaccatttattgagtttctgaaggccatacaagatggaacaatagttttaatgggaacatacgatgatggagcaaccaaactcaatgatgaggcacggcggctcattgctgatttggggagcacatctattactaatcttggttttagagacaactgggtcttctgtggtgggaagggcattaagacaaaaagcccttttgaacagcacataaagaacaataaggatacaaacaaatatgaaggatggcctgaagttgtagaaatggaaggatgcatcccccagaagcaagactaatggaaatgtggagagaattgaagaaagcgcactttcactcttaatgggagagctataaatggcagagctatgtgtaaatattttaagagcatgcagccatcttggtgtgtgcatgagtattgtctcttttgatatcaggattatttattgctaacgtaaatagatagcattgtaaataatcatcacaatgatcaaatcactgaaccatgtctccgcacatttccctaaaagtacaatgtttagactgctatggtaatacatattttaaattctaaaagcatacacaatgtgtaactgaatggtttgtgaaaaatatattgatatatatactagttgctgtgaaaatatcatggaataatagggattttagggtggatactttattttcttttatatttctatatgttgccttgtgatgacattatcttttaaattaaaaagagatttggctagttgtgtgtgtaatgttactttacagtccgactctcctgatgtacctcttttcatgatctttttctttccttcccaagaaactgaggaatgtttaatatgaaaacatacatcggatatgtgaaaagcacaacaaaattcttaatgtacacagtaaaaaagtaaatatataaatgtagatggcatttaggaccacagcttgctggatttgtgttagctatgggaataacttgattttgtataagctatttagagtgaggctggaggtggcagcttcacagaactggagaaccaggccaagtcccctccccaacctaattaggtcattcaggacagctaagtcagtatatttagagcaatactagcatacgtttttcttaattgttatcagcattgaccaagtggtttggaaggaggcatgctttaatatcacaataattttgatttgtaaaccaagaaattaatcctgtgtttatctaacttcataatagcaattattgcccgaagctatagtggcatatttacaaaagttcttattactgggcggactgataacatttaaaaaataattgtgtttgaccccaaatgactttatacccaattctacataaaaatatagaagatctatctttttttgttaccttcagatgttcactaaataactcagtttttaagcagaagttttcagggcattaaatatatgttgtgtatgaagtatctcaaactggaacataaatttagtgatcaaactgccattcacagtgtaaggcagcacttaaatttcgaacctaaagtttagatgcattgtataaaaaaacctaaaagcagtatctgttatttagctgtaaaccaagttggaagctattcggataatttcttaaatattgatgaactttggagtactgtttcttccttcaaactgaatgtaattaattcatgaataaatgcaccttatatgtttaaacaatctttgtatacttttgggatttttggtgcttatatgctaaatcacattcagcatgtgtattttgacatttaaaatacttccctcaattctgtaaattaaaagaatagttattttacagttccagggattgtgaaataaatgttgcagttttttaaaataatgaaaataaatactcttggttttgctttgtgaattttttttttttttgtattatctggcaaagtaatatacctacagaacttcacaaaaactcacacaaggtttttcaagcatttattatactgcctaacttggaaaaaaaattgttgctgtggttaaaaatagtaatatcctagatgtatcttaacatgtaagaagctaagtatctagatggcggaaaaagcccttttattaagactgtaaaaggatagcttttccagatatataaaatgttaaaagaagacaaagattggttatgttaactggtgtggtttccttttgtctcagttcaatcttgtatagattgtgccaacttaactttga

SEQ ID NO: 352 - DNA, 4339 bp, Homo sapiens
atgcagtacaaaccagtgtcctccagagtccgctgtgcctacggccagagcagcgacagagccttcctcaaacctgtagtgactgccacactttgcaaggacaccgtagagggggcatgtccgcgctccaacttcctcccgacgcagcctctgattggctcctgggcttataagaaacgcgtgaatgagcagctgccgcgggcagaaagttgccggaggtctccgggtggtatcgccctttcctctttgccagcccgctggcgagccgagccagggcaagatgaggtcgtcctgtgtcctgctcaccgccctggtggcgctggccgcctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactgatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttcaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtattttttaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacagacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctgggaatgtgctttcatt

SEQ ID NO: 353 - DNA, 4116 bp, Homo sapiens
cggaggtctccgggtggtatcgccctttcctctttgccagcccgctggcgagccgagccggggcaagatgaggtcgtcctgtgtcctgctcaccgccctggtggcgctggccacctattacgtctacatcccgctgcctggctccgtgtccgacccctggaagctgatgctgctggacgccactttccggggtgcacagcaagtgagtaacctgatccactacctgggactgagccatcacctgctggcactgaattttatcattgtttcttttggcaaaaaaagcgcgtggtcttctgcccaagtgaaggtgaccgacacagactttgatggtgtggaagtcagagtgtttgaaggccctccgaagcccgaagagccactgaaacgcagcgtcgtttatatccacggaggaggctgggccttggcaagtgcaaaaatcaggtattatgatgagctgtgtacagcaatggctgaggaattgaatgctgtcattgtttccattgaatacaggctagttccaaaggtttattttcctgagcaaattcatgatgttgtacgggccacaaagtatttcctgaagccagaagtcttacagaagtatatggttgatccaggcagaatttgcatttctggtgacagtgctggtggaaatctggctgctgcccttggacaacagtttactcaagatgccagcctaaaaaataagctcaaactacaagctttaatttatccagttcttcaagctttagattttaacacaccatcttatcagcaaaatgtgaacaccccaatcctgccccgctatgtcatggtgaagtattgggtggactacttcaaaggcaactatgactttgtgcaggcaatgatcgttaacaatcacacttcacttgatgtggaagaggctgctgctgtcagggcccgtctaaactggacatccctcttgcctgcatccttcacaaagaactacaagcctgttgtacagaccacaggcaatgccaggattgtccaggagcttcctcagttgctggatgcccgctccgccccactcattgcagaccaggcagtgctgcagctcctcccaaagacctacattctgacgtgtgagcatgatgtcctcagagacgatggcatcatgtatgccaagcgtttggagagtgccggtgtggaggtgaccctggatcactttgaggatggctttcacggatgtatgattttcactagctggcccaccaacttctcagtgggaatccggactaggaatagttacatcaagtggctagatcaaaacctgtaaaggagcaaaacttccagaagcctcgagcccctcttgacctcctacacctgctttggaaagacatgcactttttagttgactaattcttcctcccattcccctctacttgcgagttatggaatttctattccataactgaagtctttatgataacctaatttttaaaaatgaatttgactaacttaagtgcaaaacatgtaaatttggttcccagagtgggccaatctctctgttcttgttatcttagccaactatactcatacctacagctacagaaagcaggactaggaactggaaataactttgggtcctgccttcattaggacgttctttttagaagcagttcttccagctctggatcatagagtgacctttaataagttaaaaaaacgaggactccttaattctgctagagttaaccttgagttcagagcagtattaaatgcgtgcactttcaggtcagtactggggaccaagtaccctctggtcttttgtgaatggatggttttgtttcctatgggaattttggcaaaggttttctggaaagaacaagtttctcaaaggactttcttcctctagaatgttcattttatgagatcgctatctgtaagtccagttggattacaggaatacttgaaagttactttctaccactattagaaaatatgaagtcgcatgcactggatatctatatatcattaggtttttgttgtgtttttggttatgctgtcccccttctccttggggagatatttgggagcaaacttatttagatttagagtaaacttttcattatagagcaagtaaaaacagacaaatgaaacaacctagtgtttcacataaaaatacttctgacataaagtaccaagagcagtgtgaatatacttggcatagtcaaaaaagaaaatacatttaatattagttaaaaattgttaaaaatacctttagaaggtctagtctattattgaaaactcaattttttcacttatatggctttaaaatggagctattttgctacaatataatgtattgtttatttttttaagttatttaatgttaatatacatagctagacttaaggtttttcagaaagatgtccataataaatattaaaaacaatggtatttttaaaaaaactgccttagggttttaaaaccttccctacagttataaccacgtgtaattttgtggaaatgatataacagctattaatactactataacataggcataaatattttcgtgtttatatgcatatacaagttaaaataattagaaactatgactgcgcctagtaaagtcatctaggtttatagttcagtagcttaggcaaggcacacactgctcatctccgctttttagggtcagaggaacacaagctcatgttctgagtgaagggcgtacactggcacctggtgttgcctagatcccccatctcctccttccagccaggtctggaagtttcaacagcccaagcttaacttcatgtaaagtcttcactgccagtgggaacatctttgacacaacaagacactccaattgtgatttgagttgaggatctctgcctgccttcctgccgtccttccttcttccccgatccatgctacttttaggggctgcggagagcagcagcagagctgagtaatgatacagggcaccacggagagaaagtagaaccatttcactcctgggaagatggggtatttcccacttccagcaacgaaataacaaatgaaaagttgcatacttattgatgtattgtatgagccagtagcattttatgtacaaaacagaagtcaatgcaacagtatgtatgtgtgcctgtgtgtgtataaaaataaccattgaagctaacttgctaatgtacttaggcaagccacttcccatctctgggcctcgtctttcctccctctaaaatcaaagagctgaattatgtgatccttgaggtctcttccacttataataccaactgtcttgtcagactggcaaattatattggcctctccttatgtggtggtttttttggtaggtcatagttccttatacacggacacctgcatcatcgaaggtctttttttcctaaaaaaaaaaaatgggattttagttcttattctgtgataactatcctcctcatataatactattctttttgacaccatttgaaggaaccaatatttggaccttattttgaggttgtctgtctcgaagaaaaagaaaataaaatgtataggcagggttccttcaattggcattttccccagaattgtgagccaaagcctatagtaattgcagacagcaaatgattccggatctctaaaaggctctctcagatgaaaagggagtaaaggaaaaaagagggaggtcaaccactgtttctgataatgtacttgagtttcattgttcttttagtttgtattcttataaaaaatgtttacactctgcagattgattttttttttttagtactgtggctttcttttcctattttatgaaaaaaatgataatctttttgtaaaattgtctgtgaaatataaacattaatatataaagaaaaaccttgaagtgctgtatagtgaagtataaattaatgttttattgatttgtgaagaatttaagactattatataattatcttggtggatctattttatgcatgaccttttaacctttgactttgcttatttcccactacgaaggggaaggtagattttatgaatgattttaatagcaaatatattttataaagtgaaaatccagtgtggaggtagcaaagcatctatctattctgaatcatgtttggaaataaaattgctccatctggg

SEQ ID NO: 354 - DNA, 2375 bp, Homo sapiens
atggctcaggtggactccgggctggagctgtcctgggggagcttgtttgcggcagcggctgctgctgccactgctgtgctgggggcccggtcgccagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaaggaatgtggggtgggcagtggggaacgtaacttaaattagatcatcagaaagtcctccctgaggagatgggatttttttgttttttagagacagggtttcactctgtcacccaggctggagtgcagtggcacaatcacacctcactgcagcctcaacttcctgggctcaagtgatcctcctgcatcagcttcccaagtagctgggactacaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtgaaagaaaaggtcagaaaaggaggcaaggggcttataagggtgtgataagaagcttgatgtttacacttaaatacattgggaattctcttatcagttaagtctctttaggtgaaaggacaaaacctaccttaaactagcttaaacaa

SEQ ID NO: 355 - DNA, 2772 bp, Homo sapiens
ccgcgcagcgcgggcgcagagccctgccctcagctgaagggagtcttctttttttttttttttttccgctgtttttttctccgcccctaagaggttgactccaaacccggagttccgctaggtccaacaggagggcttacggcgtgagcggcgtacctggggagaggcttaggcagcggcaaccgctgattggcagtaaaggggttcactccccatctcctgctcgggcgaaaccgggacagccaatcagagagagtactgacggaaacggcccaatcctggagcagggctgagggagggggcggggacaaatggctcaggtggactccgggctggagctgtcctgggggagcttgtttgcggcagcggctgctgctgccactgctgtgctgggggcccggtcgccaggcaaaaagccctcccacgtttgaggggagtcatgagccgtttcctgaatgtgttaagaagttggctggttatggtgtccatcatagccatggggaacacgctgcagagcttccgagaccacacttttctctatgaaaagctctacactggcaagccaaaccttgtgaatggcctccaagctcggacctttgggatctggacgctgctctcatcagtgattcgctgcctctgtgccattgacattcacaacaagacgctctatcacatcacactctggaccttcctccttgccctggggcatttcctctctgagttgtttgtctatggaactgcagctcccacgattggcgtcctggcacccctgatggtggcaagtttctccatcctgggtatgctggtcgggctccggtatctagaagtagaaccagtatccagacagaagaagagaaactgaggccagcattatcacctccaggactttctcgttttccaccttggccatcttcttccttcgtcgtctctcctctttaatttcttttctattccatcatctgcccttttattcacttttagcctctttttttaatttttaaaatttaaagatatgcatactgaaaagtatataacatgtacgtacaatttaaagaataattttaaagtgaatactacgtaactccatccaagtcaagaaattgccagcttctcggaagcccactgtgtctccttcccctacctgcaacctcttccaggctcccttttccagccttcccctttttcccttttattttcatgccttgatttgacttgtgtggtgggaacatgtgaactatgaaacttaaacctgctgcccacccagagcagctgtgaccaagggctgcctcaaggggttgtccacgcaggttgggctcctctctgctgctggacccaagactctgaaccttccaagggacaggcagttcttctaagaagggctcccctgtgtgtgagcaagaccacagctctccttctatctacagatgcatgagggttggaagagtctgggctgtttttagaccttctggtcagctgtatttgtgtaacaacttttgtaataaatagaaaaaccctctgctctgatcagttcttgtactttgacctctgctaagacaagagcatggctgcctcctctgagccctaggagaatcacagctttatgcctgattgaatacaccatagtgagtaggacagctcatgacacaggtcagcctggctgcctccggctccttactgtcatttgctcattcctcttgtattcttgaagtcaaatcttcttttttctcaccttcaagagtctgcgttcacaactaaacactaagtgccctttcttatttcctcctaaagaagaaacagattcttgagagagcagagacaaaaaaatagaactaggcagcatagatgaaacaactgcatgacatgggaagaagacaactaaaccccgaggagaatgcactggaatggacagttgctcttaaaccctacccagagggcctcccccagctggaccctcatacacagtgtgtgtatccaaaaggccattgctatttcagcaaatatttgttgagtacttctccatgccggacacttgggaaagagaaatgaacgacacaggcaatgcccctgccctgtgggccttatattatagtcaaggtaacagaatcaacaagccaacacaaaaataaagaacttcaaatagggataagaactctaacaaacacaaggtattttggtcaagaaggaatgtggggtgggcagtggggaacgtaacttaaattagatcatcagaaagtcctccctgaggagatgggatttttttgttttttagagacagggtttcactctgtcacccaggctggagtgcagtggcacaatcacacctcactgcagcctcaacttcctgggctcaagtgatcctcctgcatcagcttcccaagtagctgggactacaagtgtgtaccaccacatccagctaacatttttgggggtgggaagagatggggtcttactatgttgtccaggctaagaggtgggatttgagctgagacttgaatgcccaggagttaaatgtcttaagatatggagcaggccgttagaaaggagggagcagcaactggaaggtagaatagtcttattcaaggaataagaactatgtaatcacagcatggtgaagagttaggaagtgaaagaaaaggtcagaaaaggaggcaaggggcttataagggtgtgataagaagcttgatgtttacacttaaatacattgggaattctcttatcagttaagtctctttaggtgaaaggacaaaacctaccttaaactagcttaaacaa

SEQ ID NO: 356 - DNA, 5895 bp, Homo sapiens
gtcagtcaagggaatttctatctaagcacttaccagcaatttgagctccttctcttttggtctaggtggctctaaaataacaataaaggctacagtgattgaaattcaccagacttgaaatagactgcagccttcttccttcccaccttcttagaatctttgtcctattcatcttccttacgcttccccgggttctcttacttctggattctaacagtgagttgtgagaagcaacgcggaaaacggaatggagactccagcttgttttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcggagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatg

SEQ ID NO: 357 - DNA, 5105 bp, Homo sapiens
tcagtcaagggaatttctatctaagcacttaccagcaatttgagctccttctcttttggtctaggtggctctaaaataacaataaaggctacagtgattgaaattcaccagacttgaaatagactgcagccttcttccttcccaccttcttagaatctttgtcctattcatcttccttacgcttccccgggttctcttacttctggattctaacagtgagttgtgagaagcaacgcggaaaacggaatggagactccagcttgttttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcggagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcaga

SEQ ID NO: 358 - DNA, 5834 bp, Homo sapiens
gtcagtcaagggaatttctatctaagcacttaccagcaatttgagctccttctcttttggtctaggtggctctaaaataacaataaaggctacagtgattgaaattcaccagacttgaaatagactgcagccttcttccttcccaccttcttagaatctttgtcctattcatcttccttacgcttccccgggttctcttacttctggattctaacagtgagttgtgagaagcaacgcggaaaacggaatggagactccagcttgttttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcggagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccaggaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgagtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatg

SEQ ID NO: 359 - DNA, 5727 bp, Homo sapiens
tttaaacgagctgtattaccccgcacagtgcaggagaaaagataattggctcaggtctcggctctgccatctaccacctgtggagccttagataagtcagttcttatctctgtcactcaacggtctcggtcttgtcatcttttacatggaatgtcatgaaatatacagtacattgcaggaactgcctcaggtaaagacttctagggttcagtaggtctcagtcgatccctctgagaaaggccgcaccctaaatgcacagactctgactctaaggggatggggtcggggaatctgcattttagtagcttctcaggtgattcagatgctcagtcaggattgagaaaccaggactcttcccagccctcctgttctctgatccacttctctgcttcctccacgtcctaacgattctccagttcccgcacagcaggagcggagggaagaggggagagaaggcaccgctaaggaccgctggccccgccaggcggccgacctccccattccaggggcgccagccggcggattacataacgggcctcggggcgcgttctcgcgaggtttccaccgccccctcctcgctccacgtcagagggaaccgggcggagcggccaacatggcggaacgcaggagacacaagaagcggatccagtataatttcagattctcgtgtcccatcgaagtttctagcaagaggactgttgtcacatttccttcttggactcattactggtcactgaaaaccagaagaagttggtgaaccatctaaagaagagaaggctgtggccaagtatcttcgattcaactgtccaacaaagtccaccaatatgatgggtcaccgggttgattattttattgcttcaaaagcagtggactgtcttttggattcaaagtgggcaaaggccaagaaaggagaggaagctttatttacaaccagggagtctgtggttgactactgcaacaggcttttaaagaagcagttttttcaccgagccctaaaagtaatgaaaatgaaatatgataaagacataaagaaagaaaaagataaaggaaaagctgaaagtggaaaagaagaagataaaaagagcaagaaagaaaatataaaggatgagaagacaaaaaaagaaaaagagaaaaaaaaagatggtgaaaaggaagaatccaaaaaggaggaaactccaggaactcctaaaaagaaggaaactaagaaaaaattcaaacttgagccacatgatgatcaggtttttctggatggaaatgaggtgtatgtatggatctatgacccagttcactttaaaacatttgtcatgggattaattcttgtgattgcagtaatagcggccaccctcttccccctttggccagcagaaatgagagtaggtgtttattacctcagtgtgggtgcaggctgttttgtagccagtattcttctccttgctgttgctcgatgcattctatttctcatcatttggctcataactggaggaaggcaccacttttggttcttgccaaatctgactgctgatgtgggcttcattgactccttcaggcctctgtacacacatgaatacaaaggaccaaaagcagacttaaagaaagatgagaagtctgaaaccaaaaagcaacagaagtccgacagtgaggaaaagtcagacagtgagaaaaaggaagatgaggaggggaaagtaggaccaggaaatcatggaacagaaggctcggggggagaacggcattcagacacggacagtgacaggagggaagatgatcgatcccagcacagtagtggaaatggaaatgattttgaaatgataacaaaagaggaactggaacagcaaacagatggggattgtgaagaggatgaggaagaggaaaatgatggagaaacacctaaatcttcacatgaaaaatcataatctgactaattttgggactgaatgaataagtacaagaggttggattttctatgttggctgattaccatattgaacacatggcatttgtagcattctttaaatctatctactgaaatgtatttgacattcaagcagttatattcggtccttcattttatagaatattggcactattattggtacagtttaaagccattaatatgttttatccatttgataattttacagtaagtaggtctcattcattttgacagttatcaaagatgtactttccacagttaaatttacattaatggcaatttttgatagttttatggctttttactgttagactaatcaaaaataactttaaaaggaacaaagaaactccaacatttcacattatgcatagttatgtagccatttcacagtttctttaagatgtgtaaactcattgtccttgatagtttttatttttcattataaaattataccaggagatttcttttaagattctgagttagcagagttcaaaactattttgtggaaacaagccaactagtaacaatgcagcaacacttctggtttagctaaattatttttccaatgtaggaaatccacactgatttgtacgtctgactgagagaaagatggtcgtctccagcagagaaagtgaacagcatttgttggaaggtgatggctctccctcctccctccccatttcattggcgtaacgtaaagtgtattctgtacataatttacaaataaaacattttattttaattgttacttattatttagatatttctcaacacttaaattcataaaattaagaccatgtaagggtatgtttttagagaaatggaagtttgagtaacccacagaacatctgtgatctttctacagcagcttcagttttgtgccaacattccatgtattttgaatatgagcaaaaactgatcttaagagcagacttaaagtagctttgtacgccttaatgttcattttgatttattttaaatctttacattcagaaatgagatactgtattatcagaccaggaggcattgctgtgaaagataatttcctattctaaaatatcaaatttaaaataaagataatgaaagaaaacataagagaactattggactctaattgctttgaactagttttgcagtttgactttacgtcttatacatcttagttacaagtctttggaaactcttgtttacttatgagcataatcattccttggagttatactaactaataatgaatattaaatgatttttcttcagtcacagtgagagcatcttgctttgtggttgaaataggtagtgtatgtcagtctttgctttaggctgtttctcatctaagtgtttgaattaaagatgttaaatttttctaattgtgaaaaatatgttttctgtatcgacacattttattaaacttggcttgattgcttctttatagtagtccctgtaagtggacataaatgtggctatttgatgttaatgcaactatgtcaaggctgcaatcactttaatagtttctttttagcaaataaatgttcattgatgaagtgcctgggtattttcccgtcccatttgcagagctctactacttcatttccacagtaagcatatatataatgatcacttctgagtttatcaccagtaacattgatacctattttggggtataaacatggtgtttttcagaaataaaaattatttcattaacctttactattactgtgataatacccaggcactcaatattcatcctgaaattttttataatatatgtaatttgtctagtcttaaagacatttggagcatggccaacaggaaggtcagcttcttactgatgtgtgtggattcttacagaatgttagtacaaatttttataaatatttggtgatccctggggggaaatatcattcttactatggttagaaagtgaattagaaatttcagctcagtttctattttactattcaagttgtgtactttaaacaaatataaaaatcaaaaggctgcctctattacaatcctcagtggaatagatggctatctttcttggctaacattaaatattcttgtaccagagcatggaaaatcgtttataattgttaatagaatggcgatttttttttaagaacttcagatttgctatgctgctgtaagtagaaagcatgaagctttttgatcatgtagggcttattgtagagggtatcaattggcctaactaagcaggattgaatttaccagaggctaagttcagatagtaagaataatgcatatgtgattgttcttaaagtcaatgtattaaataaggtatttttccttttccctcttactggatttttcaattttcaaaccatatggcctaggtaactttaattgaaataatatagatttagttgaatactattcaggaagtaataaattttaatatatcacattgaaattatgcagtggtgatgaattttggtgtttcccccctctttctggttttacatcatgaggatcagttagctgctgacaagaaaagtcatcttgtgtcttttgtaaattgaattttttttttaaatctattaggaactggaaaacagcaagtatggttgattctcattattcaaggtagttacgttctataaagtcactgcgaacactgaattagcaaatatagaacctaggggaaatacaaggctagatttctgcaagccactggtcacattttcatcaagcagtcaacatgtaaatttctgttgtaaagacaccttatttaatataatcgattcattaacattgaagtcatgaccaacaacactgtaactcatgcctgaatgaagcttatctgacacataagcttcataaggcacacaacagcctttttacccttaggaacagctttttgcccttagcactatgcttgggggccattttaaacagtgaaatcaaaaaaagaacagaaatgcaaaaaccatggcattagcgtaaaaaggacacgtttatagtatgaaagctggaacatggccttgttcaacctcagctcagaatatgtgtacagcaagttttttgctgtaccacaaaattttaggttaggcaaattcacaaatacggaatccatgaataacgaggatcaactgtacttaactatattttaaagctgtgacatttatctacctggtttatggaatagaatttattgctgaatcatgctccagtatttgagtgatgttttaaatatcctatgtctgaaaataattcctcctaattgtgtggtaatttgcttttactgtttccacagtatttcaggtctttgctcattcactcagtaatactgagcacttaccatgtaccagaattttactaggcacaaccatgaataaaaatacaattctcttgcaccattaaatagtgtgttaagtgctacggcagcaaattgctacatgtgctggatatctcttgttttcccctccagctccactctgctcttgcccacaaagctgacccgaatggaccacagcagtgggctcctatgcctcctggcttctgagtgggtttggccaaggagtgtcctggccagagatcagaggatggtagggtgcctattctcggctcttctcctggggttggggggctgccttagcagccaaaggtcacttctcccaaactccttccctgctttccaggttgccagtccctgcactcttcctttctggccaaggatgatgtcagttctgctgctactagcctggagttgcagaagctactgtgcttcctctttgggtagcctatacctatacttatctcctcataatatcttcatg

SEQ ID NO: 360 - DNA, 2799 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattttgtggattctttgttttgtttcccagatttcaggaaacattttttctttcaagctatcta

SEQ ID NO: 361 - DNA, 2976 bp, Homo sapiens
ctcagggcagagggaggaaggacagcagaccagacagtcacagcagccttgacaaaacgttcctggaactcaagctcttctccacagaggaggacagagcagacagcagagaccatggagtctccctcggcccctccccacagatggtgcatcccctggcagaggctcctgctcacagcctcacttctaaccttctggaacccgcccaccactgccaagctcactattgaatccacgccgttcaatgtcgcagaggggaaggaggtgcttctacttgtccacaatctgccccagcatctttttggctacagctggtacaaaggtgaaagagtggatggcaaccgtcaaattataggatatgtaataggaactcaacaagctaccccagggcccgcatacagtggtcgagagataatataccccaatgcatccctgctgatccagaacatcatccagaatgacacaggattctacaccctacacgtcataaagtcagatcttgtgaatgaagaagcaactggccagttccgggtatacccggagctgcccaagccctccatctccagcaacaactccaaacccgtggaggacaaggatgctgtggccttcacctgtgaacctgagactcaggacgcaacctacctgtggtgggtaaacaatcagagcctcccggtcagtcccaggctgcagctgtccaatggcaacaggaccctcactctattcaatgtcacaagaaatgacacagcaagctacaaatgtgaaacccagaacccagtgagtgccaggcgcagtgattcagtcatcctgaatgtcctctatggcccggatgcccccaccatttcccctctaaacacatcttacagatcaggggaaaatctgaacctctcctgccacgcagcctctaacccacctgcacagtactcttggtttgtcaatgggactttccagcaatccacccaagagctctttatccccaacatcactgtgaataatagtggatcctatacgtgccaagcccataactcagacactggcctcaataggaccacagtcacgacgatcacagtctatgcagagccacccaaacccttcatcaccagcaacaactccaaccccgtggaggatgaggatgctgtagccttaacctgtgaacctgagattcagaacacaacctacctgtggtgggtaaataatcagagcctcccggtcagtcccaggctgcagctgtccaatgacaacaggaccctcactctactcagtgtcacaaggaatgatgtaggaccctatgagtgtggaatccagaacgaattaagtgttgaccacagcgacccagtcatcctgaatgtcctctatggcccagacgaccccaccatttccccctcatacacctattaccgtccaggggtgaacctcagcctctcctgccatgcagcctctaacccacctgcacagtattcttggctgattgatgggaacatccagcaacacacacaagagctctttatctccaacatcactgagaagaacagcggactctatacctgccaggccaataactcagccagtggccacagcaggactacagtcaagacaatcacagtctctgcggagctgcccaagccctccatctccagcaacaactccaaacccgtggaggacaaggatgctgtggccttcacctgtgaacctgaggctcagaacacaacctacctgtggtgggtaaatggtcagagcctcccagtcagtcccaggctgcagctgtccaatggcaacaggaccctcactctattcaatgtcacaagaaatgacgcaagagcctatgtatgtggaatccagaactcagtgagtgcaaaccgcagtgacccagtcaccctggatgtcctctatgggccggacacccccatcatttcccccccagactcgtcttacctttcgggagcgaacctcaacctctcctgccactcggcctctaacccatccccgcagtattcttggcgtatcaatgggataccgcagcaacacacacaagttctctttatcgccaaaatcacgccaaataataacgggacctatgcctgttttgtctctaacttggctactggccgcaataattccatagtcaagagcatcacagtctctgcatctggaacttctcctggtctctcagctggggccactgtcggcatcatgattggagtgctggttggggttgctctgatatagcagccctggtgtagtttcttcatttcaggaagactgacagttgttttgcttcttccttaaagcatttgcaacagctacagtctaaaattgcttctttaccaaggatatttacagaaaagactctgaccagagatcgagaccatcctagccaacatcgtgaaaccccatctctactaaaaatacaaaaatgagctgggcttggtggcgcgcacctgtagtcccagttactcgggaggctgaggcaggagaatcgcttgaacccgggaggtggagattgcagtgagcccagatcgcaccactgcactccagtctggcaacagagcaagactccatctcaaaaagaaaagaaaagaagactctgacctgtactcttgaatacaagtttctgataccactgcactgtctgagaatttccaaaactttaatgaactaactgacagcttcatgaaactgtccaccaagatcaagcagagaaaataattaatttcatgggactaaatgaactaatgaggattttgctgattctttaaatgtcttgtttcccagatttcaggaaactttttttcttttaagctatccacagcttacagcaatttgataaaatatacttttgtgaacaaaaattgagacatttacattttctccctatgtggtcgctccagacttgggaaactattcatgaatatttatattgtatggtaatatagttattgcacaagttcaataaaaatctgctctttgtatgacagaata

SEQ ID NO: 362 - DNA, 1547 bp, Homo sapiens
ctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 363 - DNA, 1792 bp, Homo sapiens
gaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 364 - DNA, 1297 bp, Homo sapiens
gacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 365 - DNA, 1670 bp, Homo sapiens
gaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacatt

SEQ ID NO: 366 - DNA, 1269 bp, Homo sapiens
gaagccactgtgcatgctctatcaccagcctcaccctcctggtcagccttacaagagtgacactggatatactccagaagttggacccaccacagcctgcacactggacttcttggcttttatgagctattcaagagatatttagtcatcacgttgtgtcacaatgggagtgactcacagagcaaggagagaacctgaggattcctcacacatgtagtactcagagctctacggaaacccaggcacctcgacctcaagaggatcagcctggccagggtggcacaactcttccttccccgtgcacagcaggaaagctgccatcagctgagcaagtccaccaacagtttctgtgtcccacttcatctttaataaggacaccatcttcttgtattatacaagaaaggagtgtacctatcacacacagggggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaatatgcttcctttggtcaagaaagctcaagggagagttattaatgtctccagtgttggaggtcgccttgcaatcgttggagggggctatactccatccaaatatgcagtggaaggtttcaatgacagcttaagacgggacatgaaagcttttggtgtgcacgtctcatgcattgaacgtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtg

SEQ ID NO: 367 - DNA, 1390 bp, Homo sapiens
gggaaaaatgctcttttgggtgctaggcctcctaatcctctgtggttttctgtggactcgtaaaggaaaactaaagattgaagacatcactgataagtacatttttatcactggatgtgactcgggctttggaaacttggcagccagaacttttgataaaaagggatttcatgtaatcgctgcctgtctgactgaatcaggatcaacagctttaaaggcagaaacctcagagagacttcgtactgtgcttctggatgtgaccgacccagagaatgtcaagaggactgcccagtgggtgaagaaccaagttggggagaaaggtctctggggtctgatcaataatgctggtgttcccggcgtgctggctcccactgactggctgacactagaggactacagagaacctattgaagtgaacctgtttggactcatcagtgtgacactaaacatgcttcctcgacctcaagaggatcagcctggccagggtggcacaactcttccttccccgtgcacagcaggaaagctgccatcagttggagggggctatactccatccaaatatgcagtggaaggtttcaatgacagcttaagacgggacatgaaagcttttggtgtgcacgtctcatgcattgaaccaggattgttcaaaacaaacttggcagatccagtaaaggtaattgaaaaaaaactcgccatttgggagcagctgtctccagacatcaaacaacaatatggagaaggttacattgaaaaaagtctagacaaactgaaaggcaataaatcctatgtgaacatggacctctctccggtggtagagtgcatggaccacgctctaacaagtctcttccctaagactcattatgccgctggaaaagatgccaaaattttctggatacctctgtctcacatgccagcagctttgcaagactttttattgttgaaacagaaagcagagctggctaatcccaaggcagtgtgactcagctaaccacaaatgtctcctccaggctatgaaattggccgatttcaagaacacatctccttttcaaccccattccttatctgctccaacctggactcatttagatcgtgcttatttggattgcaaaagggagtcccaccatcgctggtggtatcccagggtccctgctcaagttttctttgaaaaggagggctggaatggtacatcacataggcaagtcctgccctgtatttaggctttgcctgcttggtgtgatgtaagggaaattgaaagacttgcccattcaaaatgatctttaccgtggcctgccccatgcttatggtccccagcatttacagtaacttgtgaatgttaagtatcatctcttatctaaatattaaaagataagtcaaacattaaaaaaaaaaa

SEQ ID NO: 368 - DNA, 4635 bp, Homo sapiens
aagaacacagccagcccgccctctcctgctgttgctgcagctctgacttgctttttcctgcctccttcctctcctctctcttcttgcttagcttcttgccttctgatactactcccaagatggaggctaatcactctgaacagctctcagcggaacgacagtcaacacctccaggtgacagttcatcattacccagtcacaatggcctggagaaggaagatggccaggattctccaaccccagtccaaccaccagagaaagaggcaagtgtgcaccccgatatctctgaagagctgaatcgacagctggaagacatcattaacacttatgggtctgctgccagcacagcagggaaagagggctctgccagggccagtgagcagcctgagaatgcagaatcacctgacaacgaggatggggactgtgaggaaacaactgaagaggctggaagagaacccgttgcttctggagagccacccactgtcaaagagcccgtcagcaataaggagcaaaaattggaaaagaaaatcctaaaaggattaggcaaaagccaacctgctaatgcaaaatctgaacaagttgcaaacaccggaagaaaagtttgattttttattcaagaagtatgctgaattgctggatgaacatcgtactgagcaaaagaagttaaagctcctccaaaagaaacaggtacaaattcaaaaagaaaaggaccagttacaaggtgaacacagcagagctatcctcgctcgaagcaaattggagagtctgtgccgggagctgcagagacacaacaagactctgaaggaagaggcgcttcagcgggcacgtgaggaagaagagaaaaggaaggaaatcacaagccatttccagagtaccctcacggacatccagggccagatcgagcagcagagtgagcgaaatatgaagctctgtcaggagaacacagagcttgcagaaaagctgaaaagcatcatcgatcagtatgagctcagagaggagcatctggacaaaatatttaaacacagagaactgcagcagaagctggtggatgcaaagcttgagcaggcccaagaaatgatgaaggaagcggaggagcgacacaaacgagaaaaggaatatttgctgaaccaggcagcagagtggaaacttcaggcgaaagtgctgaaggagcaagagacagtcctgcaggctcagctcactctctactcaggaaggtttgaagaattccagagcacactaactaaaagcaacgaggtgtttgccacgttcaaacaggaaatggacaaaacaactaagaaaatgaagaagctggaaaaggacacagccacatggaaagcccgatttgagaactgtaacaaagctctgttggacatgattgaagagaaagcactgagagctaaagaatatgagtgctttgtgatgaaaatcgggaggctagagaacctctgccgtgctttacaagaagagagaaacgaactccacaaaaaaatcagagacgcagaaatatctgaaaaggatgaccaaagtcagcacaactccgatgaagagccagagtcaaacgtctctgtggatcaagagattgacgcagaggaggttaatagtgtccaaaccgccgtgaaaaatctggccacagccttcatgataattcatcatccagagtcaaccccgcaccagtccaaagaaacccaacccgaaataggcagttctcaggagagtgctgacgccgctctcaaggagccagagcaaccccctctgatcccttcacgggattcagagagtcccctgcctcccctaactcctcaggctgaagccgaaggaggcagtgatgctgaacctccctccaaggccagtaattctcctgccgggttgggagcagaaacccaatgcgagggtctccctgttggagcacaggctgatcaggcgtcctggaagccagaggcagaagcttccggtcaggccccacaggctcccaccgaggcctccctacagaagatggaggcagatgtgcctgctccagcatgcgcagcagaagagcacgttgcagccatggtgcctgcatgcgagcccagtaggcagcccccacgagcagcagcagaggagctgccagtaggggcctcagctgggccccagccgcgcaacgtggctgacaccaatctggaaggcgtcgactaagcctcaccgtgccttcagaggcttcttcctgcctctttgcatattcagcataacagcttgtcttccgaaaaaggcattaagggctagagatgtcaaatggaagagacttaggatcaagacattttttaatgttaggcagaacacattcattcagactttgctatttgttgtcaatttatagctgatttgaaggttttctatttaacactggttgacagtataattttcccaaagggcaacaaaacatacagatagcaaatttatattccttttctgttaagataatacttaaatttgttaatcaccagtaagatttgatgtttaaagacttccactgcaatatataaatactgaaaatgtgatgttctgcttatttggatatatagtttaacaagttccatagtaatttatggatgcccaggttacatttaaactatacatatacataatatatacatacgtgtgtacttattatatgtatatatacacgtatgtatagatgtgtgaatatttgtttatatacatatatgcacgtatctatatgtatatataaatgcattattacacatacatttctctcaccccttaatgcatttttctcaatgcagaatatttagatgctaatcaaaaaaatgatctcttacttgcacttgagactatggttgactaatgctctataaatccgaagagagttcggactataagtatttaggctatcattatgttgggcaaaaataagtaacccaatggtagataaatgaattcaaccagttgatcaaatggcagaaaagcagttagactacaatctgtgcagacagcatggacacaaagatgaccacaaggggcccaaaacagaaaagagaaacacaagctcacctcttggagctgcttctcctacacttctcagcccattgctttgccaccccctcatgtgccagggcatcccattccaggcttcctgcaaggaaacggttggaagtgggaaaggggagctagggattgaggggttaagggacctcacactaagaaggggctgtgctttgatcccctgcctcttgcactaccaatgtctcaagacataatattcatctcttgctgtcagacccattctatattctaaaagcttctgctccttccttcccaatttctcctttgtagcaggaaattacacccagccctcatctcaattaatgctaaataaagctattgtttttccaaaacacaaatctacactgggtctcaatatcagtgatgaggcttacaaaccaacacgttttctgccatgaggatttctctttaggccagaagtacaaaacaaaaaaaccaatggattttaaccaaaatgatttgaaatataggtgaggattcaggagaaggcaaaagctagaaacacttggggttgtcaacatgagtattacattaacattgcttgatgagaacctctaatgatactgacaacataaattacctagggtaaaggatagctgcaacaatgaaacaggaaagaagagagggagagagaggaaagggaaggaagaaaggaaggagggagaagggaagaaagaaacaatgtctaacccaaccctatcttgaaagttgaactcaagtagaaaaatggatagaaacaaaattctctagtactcatccaggaaaccattcttcaatgttgcatgtggctgtttgccaaggcacacaaagtgcttgtaggcagcaaccatatgctacaagaattgtaaactgcatacagtttgtttgaagtagacagtgaggataataacaaagttgctaggcaggaaaaaaaatcaggaaaaaagcttgtcgctatttgagaatctgtatatttttaaaggcttaaaatattataaccacagggtatccagccaaattcaacattactgcaagtcttagagatttaaacattcatttgattcagagctaaatattcaccataatccaggagggtctccttccccactgcagaggcagaacgtccaagaatggagtaagattagtcatagtaaagtctcagtctgaatatttagcaagagaaacaggcagcagaggaacccaaaggcagtaaatcaaatattctaaaacccaaagttcattattttcatccaaaagactttcacagaaacacattactcacagccatgtatatcttggacagagtttcagatggaatgacttgtctgaaatttgtaaagcttaatataggttttgggggaattattttaatattcaaagaatgttttattatagtcctttgtgttaaaatttagccttactaattataacaataactcataaagttctaaattcagaaggaatgtctgttctttatcaagtgtatgtaactattttttagaaatgccatctactttctagaaacactaaagttattgttttctaagttaaataactataatttatatatctattaaaaaggtacttctcttccca

SEQ ID NO: 369 - DNA, 4752 bp, Homo sapiens
cagactgctgcctccatcagtgcctgtggcgtgtgtgtgtgtgtgtgtgtgtgcgcgcgcgtgcgtgcacgtgtgtatgtgtgtgtgtgtgtattgggtttctctctcccttgtaagaacacagccagcccgccctctcctgctgttgctgcagctctgacttgctttttcctgcctccttcctctcctctctcttcttgcttagcttcttgccttctgatactactcccaagatggaggctaatcactctgaacagctctcagcggaacgacagtcaacacctccaggtgacagttcatcattacccagtcacaatggcctggagaaggaagatggccaggattctccaaccccagtccaaccaccagagaaagaggcaagtgtgcaccccgatatctctgaagagctgaatcgacagctggaagacatcattaacacttatgggtctgctgccagcacagcagggaaagagggctctgccagggccagtgagcagcctgagaatgcagaatcacctgacaacgaggatggggactgtgaggaaacaactgaagaggctggaagagaacccgttgcttctggagagccacccactgtcaaagagcccgtcagcaataaggagcaaaaattggaaaagaaaatcctaaaaggattaggcaagtaaagccaacctgctaatgcaaaatctgaacaagttgcaaacaccggaagaaaagtttgattttttattcaagaagtatgctgaattgctggatgaacatcgtactgagcaaaagaagttaaagctcctccaaaagaaacaggtacaaattcaaaaagaaaaggaccagttacaaggtgaacacagcagagctatcctcgctcgaagcaaattggagagtctgtgccgggagctgcagagacacaacaagactctgaaggaagaggcgcttcagcgggcacgtgaggaagaagagaaaaggaaggaaatcacaagccatttccagagtaccctcacggacatccagggccagatcgagcagcagagtgagcgaaatatgaagctctgtcaggagaacacagagcttgcagaaaagctgaaaagcatcatcgatcagtatgagctcagagaggagcatctggacaaaatatttaaacacagagaactgcagcagaagctggtggatgcaaagcttgagcaggcccaagaaatgatgaaggaagcggaggagcgacacaaacgagaaaaggaatatttgctgaaccaggcagcagagtggaaacttcaggcgaaagtgctgaaggagcaagagacagtcctgcaggctcagctcactctctactcaggaaggtttgaagaattccagagcacactaactaaaagcaacgaggtgtttgccacgttcaaacaggaaatggacaaaacaactaagaaaatgaagaagctggaaaaggacacagccacatggaaagcccgatttgagaactgtaacaaagctctgttggacatgattgaagagaaagcactgagagctaaagaatatgagtgctttgtgatgaaaatcgggaggctagagaacctctgccgtgctttacaagaagagagaaacgaactccacaaaaaaatcagagacgcagaaatatctgaaaaggatgaccaaagtcagcacaactccgatgaagagccagagtcaaacgtctctgtggatcaagagattgacgcagaggaggttaatagtgtccaaaccgccgtgaaaaatctggccacagccttcatgataattcatcatccagagtcaaccccgcaccagtccaaagaaacccaacccgaaataggcagttctcaggagagtgctgacgccgctctcaaggagccagagcaaccccctctgatcccttcacgggattcagagagtcccctgcctcccctaactcctcaggctgaagccgaaggaggcagtgatgctgaacctccctccaaggccagtaattctcctgccgggttgggagcagaaacccaatgcgagggtctccctgttggagcacaggctgatcaggcgtcctggaagccagaggcagaagcttccggtcaggccccacaggctcccaccgaggcctccctacagaagatggaggcagatgtgcctgctccagcatgcgcagcagaagagcacgttgcagccatggtgcctgcatgcgagcccagtaggcagcccccacgagcagcagcagaggagctgccagtaggggcctcagctgggccccagccgcgcaacgtggctgacaccaatctggaaggcgtcgactaagcctcaccgtgccttcagaggcttcttcctgcctctttgcatattcagcataacagcttgtcttccgaaaaaggcattaagggctagagatgtcaaatggaagagacttaggatcaagacattttttaatgttaggcagaacacattcattcagactttgctatttgttgtcaatttatagctgatttgaaggttttctatttaacactggttgacagtataattttcccaaagggcaacaaaacatacagatagcaaatttatattccttttctgttaagataatacttaaatttgttaatcaccagtaagatttgatgtttaaagacttccactgcaatatataaatactgaaaatgtgatgttctgcttatttggatatatagtttaacaagttccatagtaatttatggatgcccaggttacatttaaactatacatatacataatatatacatacgtgtgtacttattatatgtatatatacacgtatgtatagatgtgtgaatatttgtttatatacatatatgcacgtatctatatgtatatataaatgcattattacacatacatttctctcaccccttaatgcatttttctcaatgcagaatatttagatgctaatcaaaaaaatgatctcttacttgcacttgagactatggttgactaatgctctataaatccgaagagagttcggactataagtatttaggctatcattatgttgggcaaaaataagtaacccaatggtagataaatgaattcaaccagttgatcaaatggcagaaaagcagttagactacaatctgtgcagacagcatggacacaaagatgaccacaaggggcccaaaacagaaaagagaaacacaagctcacctcttggagctgcttctcctacacttctcagcccattgctttgccaccccctcatgtgccagggcatcccattccaggcttcctgcaaggaaacggttggaagtgggaaaggggagctagggattgaggggttaagggacctcacactaagaaggggctgtgctttgatcccctgcctcttgcactaccaatgtctcaagacataatattcatctcttgctgtcagacccattctatattctaaaagcttctgctccttccttcccaatttctcctttgtagcaggaaattacacccagccctcatctcaattaatgctaaataaagctattgtttttccaaaacacaaatctacactgggtctcaatatcagtgatgaggcttacaaaccaacacgttttctgccatgaggatttctctttaggccagaagtacaaaacaaaaaaaccaatggattttaaccaaaatgatttgaaatataggtgaggattcaggagaaggcaaaagctagaaacacttggggttgtcaacatgagtattacattaacattgcttgatgagaacctctaatgatactgacaacataaattacctagggtaaaggatagctgcaacaatgaaacaggaaagaagagagggagagagaggaaagggaaggaagaaaggaaggagggagaagggaagaaagaaacaatgtctaacccaaccctatcttgaaagttgaactcaagtagaaaaatggatagaaacaaaattctctagtactcatccaggaaaccattcttcaatgttgcatgtggctgtttgccaaggcacacaaagtgcttgtaggcagcaaccatatgctacaagaattgtaaactgcatacagtttgtttgaagtagacagtgaggataataacaaagttgctaggcaggaaaaaaaatcaggaaaaaagcttgtcgctatttgagaatctgtatatttttaaaggcttaaaatattataaccacagggtatccagccaaattcaacattactgcaagtcttagagatttaaacattcatttgattcagagctaaatattcaccataatccaggagggtctccttccccactgcagaggcagaacgtccaagaatggagtaagattagtcatagtaaagtctcagtctgaatatttagcaagagaaacaggcagcagaggaacccaaaggcagtaaatcaaatattctaaaacccaaagttcattattttcatccaaaagactttcacagaaacacattactcacagccatgtatatcttggacagagtttcagatggaatgacttgtctgaaatttgtaaagcttaatataggttttgggggaattattttaatattcaaagaatgttttattatagtcctttgtgttaaaatttagccttactaattataacaataactcataaagttctaaattcagaaggaatgtctgttctttatcaagtgtatgtaactattttttagaaatgccatctactttctagaaacactaaagttattgttttctaagttaaataactataatttatatatctattaaaaaggtacttctcttccca

SEQ ID NO: 370 - DNA, 4154 bp, Homo sapiens
caaaagaagttaaagctcctccaaaagaaacaggtacaaattcaaaaagaaaaggaccagttacaaggtgaacacagcagagctatcctcgctcgaagcaaattggagagtctgtgccgggagctgcagagacacaacaagactctgaaggaagaggcgcttcagcgggcacgtgaggaagaagagaaaaggaaggaaatcacaagccatttccagagtaccctcacggacatccagggccagatcgagcagcagagtgagcgaaatatggagctctgtcaggagaacacagagcttgcagaaaagctgaaaagcatcatcgatcagtatgagctcagagaggagcatctggacaaaatatttaaacacagagaactgcagcagaagctggtggatgcaaagcttgagcaggcccaagaaatgatgaaggaagcggaggagcgacacaaacgagaaaaggaatatttgctgaaccaggcagcagagtggaaacttcaggcgaaaatgctgaaggagcaagagacagtcctgcaggctcagctcactctctactcaggaaggtttgaagaattccagagcacactaactaaaagcaacgaggtgtttgccacgttcaaacaggaaatggacaaaacaactaagaaaatgaagaagctggaaaaggacacagccacatggaaagcccgatttgagaactgtaacaaagctctgttggacatgattgaagagaaagcactgagagctaaagaatatgagtgctttgtgatgaaaatcgggaggctagagaacctctgccgtgctttacaagaagagagaaacgaactccacaaaaaaatcagagacgcagaaatatctgaaaaggatgaccaaagtcagcacaactccgatgaagagccagagtcaaacgtctctgtggatcaagagattgacgcagaggaggttaatagtgtccaaaccgccgtgaaaaatctggccacagccttcatgataattcatcatccagagtcaaccccgcaccagtccaaagaaacccaacccgaaataggcagttctcaggagagtgctgacgccgctctcaaagagccagagcaaccccctctgatcccttcacgggattcagagagtcccctgcctcccctaactcctcaggctgaagccgaaggaggcagtgatgctgaacctccctccaaggccagtaattctcctgccgggttgggagcagaaacccaatgcgagggtctccctgttggagcacaggctgatcagccgtcctggaagccagaggcagaagcttccggtcaggccccacaggctcccaccgaggcctccctacagaagatggaggcagatgtgcctgctccagcatgcgcagcagaagagcacgttgcagccatggtgcctgcatgcgagcccagtaggcagcccccacgagcagcagcagaggagctgccagtaggggcctcagctgggccccagccgcgcaacgtggctgacaccaatctggaaggcgtcgactaagcctcactgtgccttcagaggcttcttcctgcctctttgcgtattcagcataacagcttgtcttccgaaaaaggcattaagggctagagatgtcaaatggaagagacttaggatcaagacattttttaatgttaggcagaacacattcattcagactttgctatttgttgtcaatttatagctgatttgaaggttttctatttaacactggttgacagtataattttcccaaagggcaacaaaacatacagatagcaaatttatattccttttctgttaagataatacttaaatttgttaatcaccagtaagatttgatgtttaaagacttccactgcaatatataaatactgaaaatgtgatgttctgcttatttggatatatagtttaacaagttccatagtaatttatggatgcccaggttacatttaaactatacatatacataatatatacatacgtgtgtacttattatatgtatatatacacgtatgtatagatgtgtgaatatttgtttatatacatatatgcacgtatctatatgtatatataaatgcattattacacatacatttctctcaccccttaatgcatttttctcaatgcagaatatttagatgctaatcaaaaaaatgatctcttacttgcacttgggactatggttgactaatgctctataaatccgaagagagttcggactataagtatttaggctatcattatgttgggcaaaaataagtaacccaatggtagataaatgaattcaaccagttgatcaaatggcagaaaagcagttagactacaatctgtgcagacagcatggacacaaagatgaccacaaggggcccaaaacagaaaagagaaacacaagctcacctcttggagctgcttctcctacacttctcagcccattgctttgccaccccctcatgtgccagggcatcccattccaggcttcctgcaaggaaacggttggaagtgggaaaggggagctagggattgaggggttaagggacctcacactaagaaggggctgtgctttgatcccctgcctcttgcactaccaatgtctcaagacataatattcatctcttgctgtcagacccattctatattctaaaagcttctgctccttccttcccaatttctcctttgtagcaggaaattacacccagccctcatctcaattaatgctaaataaagctattgtttttccaaaacacaaatctacactgggtctcaatatcagtgatgaggcttacaaaccaacacgttttctgccatgaggatttctctttaggccagaagtacaaaacaaaaaaaccaatggattttaaccaaaatgatttgaaatataggtgaggattcaggagaaggcaaaagctagaaacacttggggttgtcaacatgagtattacattaacattgcttgatgagaacctctaatgatactgacaacataaattacctagggtaaaggatagttgcaacaatgaaacaggaaagaagagagggagagagaggaaagggaaggaagaaaggaaggagggagaagggaagaaagaaacaatgtctaacccaaccctatcttgaaagttgaactcaagtagaaaaatggatagaaacaaaattctctagtactcatccaggaaaccattcttcaatgttgcatgtggctgtttgccaaggcacacaaagtgcttgtaggcagcaaccatatgctacaagaattgtaaactgcatacagtttgtttgaagtagacagtgaggataataacaaagttgctaggcaggaaaaaaatcaggaaaaaagcttgtcgctatttgagaatctgtatatttttaaaggcttaaaatattataaccacagggtatccagccaaattcaacattactgcaagtcttagagatttaaacattcatttgattcagagctaaatattcaccataatccaggagggtctccttccccactgcagaggcagaacgtccaagaatggagtaagattagtcatagtaaagtctcagtctgaatatttagcaagagaaacaggcagcagaggaacccaaaggcagtaaatcaaatattctaaaacccaaagttcattatttccatccaaaagactttcacagaaacacattactcacagccatgtatatcttggacagagtttcagatggaatgacttgtctgaaatttgtaaagcttaatataggttttgggggaattattttaatattcaaagaatgttttattatagtcctttgtgttaaaatttagccttactaattataacaataactcataaagttctaaattcagaaggaatgtctgttctttatcaagtgtatgtaactattttttagaaatgccatctactttctagaaacactaaagttattgttttctaagttaaataactataatttatatatctattaaaaaggtacttctcttcccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaaaaaaa

SEQ ID NO: 371 - DNA, 9535 bp, Homo sapiens
ccagccgtgtgtgatgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcaaccccaacacgctggagcggctgacataccaccagctgctggaaaggtgtgtgcgtgcccccggctcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaagaagagctttttccaggctgccaccgagcacctgctcccaatgggcaccgcgctgccactcctagaggcccaggctgccacccacaccctggtggaccccatcacaggccagcggctgtgggtagacgaggcagtcagggcgggcctggtcagcccagagctccatgagcagctcctggtggccgagcaggccgtgacagggcaccacgaccccttcagtggctcccaaatcccccttttccaggccatgaagaaggggctagtggacaggccactagcactgcggctcttggatgcccagctggccacaggcgggctggtctgtccagcacgcaggctccggctgcccctggaggccgccctgcgctgcggctgcctggatgaagacactcagcggcagctctcgcaggctggcagcttctcagacggcacgcacggcggcctgcgctatgaacagctgctggccctctgtgtcaccgacccagagaccgggcttgccttcctgccactctcagggggaccccggggaggggagccccagggacccccattcatcaagtacagcactcggcaggccctgagcacggccacagccaccgtctctgtggggaagttccggggccggcccgtgtccctctgggagctgctcttctctgaggccatctcctcagagcagagggcgatgctggcccagcagtaccaggaagggaccctctccgtggagaagctggccgctgagctgagcgccaccctcgagcaggctgcagccactgccagggtcaccttttctgggctgagggacaccgtgacaccaggagagctgctgaaagccgagatcatcgaccaggacctgtacgagcggctggagcatggacaggccacagccaaggatgtgggcagcctggcctcggtgcagaggtacctgcagggtacgggctgcattgctggcctgctgctccctggctcccaggaacgcctgagcatctatgaggcccgatgcaaggggctcctccggcccggcactgccctcatccttctggaggcacaagctgccacaggcttcatcatcgacccaaaagcaaacaaggggcactccgttgaggaggcactgagggctgctgtcattgggcctgatgtgttcgcgaagctgctgtcggctgagcgcgctgtcactggctacactgacccctacaccgggcagcagatctccctcttccaggccatgcagaagggcctcatcgtccgggagcacggcatccgcctgctggaggcccagatcgccacgggcggcgtcatcgaccccgtgcacagccaccgcgtgcccgtggacgtggcctaccggcgcggctacttcgatcagatgctgaacttgatcctgttggacccttctgacgacaccaagggcttcttcgaccccaacacgcacgagaacctcacgtacctgcagcttctggagcgctgtgtgcgtgaccccgagacgggcctgtacctcctgccactcagcagcacgcagtccccgctggtggacagtgccacccagcaggccttccagaacctgctgctctccgtgaagtatggacggtttcaggggcagagggtctccgcgtgggagctgatcaactctgagtacttcagcgagggccgcaggaggcagctgctgcgtcgctaccggcagcgcgaggtcacgctggggcaggtggcaaagctgctggaggcggagacgcagagacaggcggacatcatgctgcccgcactgcggagccgggtcaccgtccaccagctcctggaggccggtatcattgaccagcagctgttggaccaagtgctggccgggacaatcagcccggaggccctcctactcatggacggcgtccgcaggtacctgtgcggcctgggagctgtgggcggtgtgcggctgctgccctctggccagcggctcagcctctaccaggccatgaggcagaagctgctggggcccagggtggccctggccctgctggaggcccaggcggccaccggaaccatcatggaccctcacagcccagagagcctctcggtggatgaggccgtgcgcaggggtgtggtggggccggagctgtatggcaggctgaagcgggctgagggtgccattgctggcttcagagaccccttctctgggaagcaggtgtctgtgttccaggccatgaagaaaggtctcatcccttgggagcaagctgcccgcctcctggaggctcaagtggccacaggagggatcattgaccccaccagccaccaccacctccccatgccagtggccattcagcgtggctatgttgaccaggagatggagacagccttgtccagctcctccgaaaccttccccacaccggacggccaggggcgcacgagctatgcccagctcctggaggagtgccccagggatgagacttctggccttcacctcctgcccctgccagaaagtgctcctgccctccccaccgaggagcaggtccagaggagcctgcaggccgtgccgggggccaaggatggcacatccctctgggacctgctcagctcctgccacttcaccgaggagcaacggaggggcctgctggaggacgtgcaggaggggaggaccactgtgccacagctgctagcctctgtgcagaggtgggtacaggagaccaagctcctggcccaggcccgcgtcatggtgcccggcccacggggtgaggtacccgctgtctggctgctggatgctggcatcatcacccaggagacccttgaggccctggctcagggcacgcagtcgcccgcccaggtcgccgagcagccggcggtgaaggcctgcctgtggggcacaggctgcgtggccggtgtgctgctacagccctctggggccaaggccagcatcgcccaggccgtgagggatggcctcctgcccacaggcctgggccagaggctgctggaagcccaggtggcatctggcttccttgttgaccccctgaacaaccagagactgtcagtggaggacgcggttaaggtcggcctggtgggcagggagctgagtgagcagctcgggcaggccgagagggcggcggccgggtacccagatccctactctagggcctccctctctctgtggcaggccatggagaaggggctcgtgccacagaacgagggcttgcccctcctgcaggtgcagctggccacagggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccctcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccgccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgtggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcccgtggacgtggcctaccgctgcggctacttcgacgaggagatgaaccgcatcctggcggaccccagcgacgacaccaagggcttcttcgaccccaacacgcacgagaacctcacgtacctgcagcttctggagcgctgtgtggaggaccccgagacgggcctgtacctgctacaaatcataaagaaaggagaaaactacgtgtacatcaatgaggccacgagacacgtgttgcaatccagaactgcaaaaatgcgcgtggggaggtttgctgaccaggtggtctctttctgggacctgctgtcctctccatacttcacagaggacaggaagcgggagctcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgcacacacttcgtgtggggaggactgggggacaggcactcagcacgctggagtgtgtgaagccctatctggaaggcagcggctgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctggctgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggacctggaaacgggacggagcacgacgcaagagctcatggaggacgaccgcgtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgcccgccgccaggagcagaccctgcgtgatgccaccatggaggtgcagcgcgggcagttccaggggcggccggtctccgtgtgggacgtcctcttctcctcgtacctgagcgaggcccaccgagacgagctcctggcccagcacgcggccggcgccctgggcctgcccgacctcgtcgccgtcctcacccgggtcatcgaggagaccgaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagtggaggcatacttgtgtgtctgggttgtttttttttttttttttttttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctctcctttttcgttttcagaacatttttctgtctgttttggattcactgcttccattttacagaatgtcactctttagactctcagtccatcatgccatcgggtactcttgttgcagtgtaatttttattacatgcggttatttccctaacgatgtgctattcacgttcatcttcaaactcattttccatcagccagtgtctactatttagtgccctggctctatttcggtcctcctccccgggctttccctggctgctgtgctggccaaaagcatgggctttattctctccattggctgctgctccaccttagaggtgtgacctcactagcgttgactgagcgagtctgttgtggagaagaactttttgtagtaatttactaggaaaaattctgaacaagtaaaatatgaaggaaactc

SEQ ID NO: 372 - DNA, 15534 bp, Homo sapiens
ccagccgtgtgtgatgagtggccacaccttgcctcctcttcccgtcccaggcaccaacagcacagagcaggccagtgtacccagagccatggcagccacgctgggagccggcacgccccccaggccccaggccaggagcatagctggggtgtatgtggaggcctcgggccaggcccagagtgtctacgccgccatggagcagggcctcctgcctgctgggctcgggcaggctctgctagaggcccaggcagccactgggggcctggtggacctcgcccggggccagctgctccctgtgtccaaggccctgcagcagggtctggtggggctggagctgaaggagaagctgctggccgctgagcgtgccactacgggctatcctgacccctacggcggtgagaagctggccctctttcaggccatcgggaaggaggttgtggacagggccctggggcagagctggctggaggtccaactggccactgggggcctggtggaccccgcccagggagtgctcgtggcccctgagccagcctgccaccagggcctcctggaccgggagacatggcacaagctgtcagagcttgagcctggcacaggtgacctgcgcttcctcaaccccaacacgctggagcggctgacataccaccagctgctggaaaggtgtgtgcgtgcccccgggtcggggctagccttgctgcccctcaagatcaccttccgctccatgggcggggcggtgagtgcagctgagctgctggaggtgggcatcctggacgagcaggctgtgcagggtctgcgggagggcaggctggccgcagtggacgtgagtgcacgtgccgaggtgcggcgctacctggagggtaccggcagcgtggccggggttgtcctgctgcccgaaggccacaagaagagctttttccaggctgccaccgagcacctgctcccaatgggcaccgcgctgccactcctagaggcccaggctgccacccacaccctggtggaccccatcacaggccagcggctgtgggtagacgaggcagtcagggcgggcctggtcagcccagagctccatgagcagctcctggtggctgagcaggccgtgacagggcaccacgaccccttcagtggctcccaaatcccccttttccaggccatgaagaaggggctagtggacaggccactagcactgcggctcttggatgcccagctggccacaggcgggctggtctgtccagcacgcaggctccggctgcccctggaggccgccctgcgctgcggctgcctggatgaagacactcagcggcagctctcgcaggctggcagcttctcagacggcacgcacggcggcctgcgctatgaacagctgctggccctctgtgtcaccgacccagagaccgggcttgccttcctgccactctcagggggaccccggggaggggagccccagggacccccattcatcaagtacagcactcggcaggccctgagcacggccacagccaccgtctctgtggggaagttccggggccggcccgtgtccctctgggagctgctcttctctgaggccatctcctcagagcagagggcgatgctggcccagcagtaccaggaagggaccctctccgtggagaagctggccgctgagctgagcgccacccttgagcaggctgcagccactgccagggtcaccttttctgggctgagggacaccgtgacaccaggagagctgctgaaagccgagatcatcgaccaggacctgtacgagcggttggagcatggacaggccacagccaaggatgtgggcagcctggcctcggcgcagaggtacctgcagggtacgggctgcattgctggcctgctgctccctggctcccaggaacgcctgagcatctatgaggcccgatgcaaggggctcctccggcccggcactgccctcatccttctggaggcacaagctgccacaggcttcatcatcgacccaaaagcaaacaaggggcactccgttgaggaggcactgagggctgctgtcattgggcctgatgtgttcgcgaagctgctgtcggctgagcgcgctgtcactggctacactgacccctacaccgggcagcagatctccctcttccaggccatgcagaagggcctcatcgtccgggagcacggcatccgcctgctggaggcccagatcgccacgggcggcgtcatcgaccccgtgcacagccaccgcgtgcccgtggacgtggcctaccggcgcggctacttcgatcagatgctgaacttgatcctgttggacccttctgacgacaccaagggcttcttcgaccccaacacgcacgagaacctcacgtacctgcagcttctggagcgctgtgtgcgtgaccccgagacgggcctgtacctcctgccactcagcagcacgcagtccccgctggtggacagtgccacccagcaggccttccagaacctgctgctctccgtgaagtatggacggtttcaggggcagagggtctccgcgtgggagctgatcaactctgagtacttcagcgagggccgcaggaggcagctgctgcgtcgctaccggcagcgcgaggtcacgctggggcaggtggcaaagctgctggaggcggagacgcagagacaggcggacatcatgctgcccgcactgcggagccgggtcaccgtccaccagctcctggaggccggtatcattgaccagcagctgttggaccaagtgctggccgggacaatcagcccggaggccctcctactcatggacggcgtccgcaggtacctgtgcggcctgggagctgtgggcggtgtgcggctgctgccctctggccagcggctcagcctctaccaggccatgaggcagaagctgctggggcccagggtggccctggccctgctggaggcccaggcggccaccggaaccatcatggaccctcacagcccagagagcctctcggtggatgaggccgtgcgcaggggtgtggtggggccggagctgtatggcaggctgaagcgggctgagggtgccattgctggcttcagagaccccttctctgggaagcaggtgtctgtgttccaggccatgaagaaaggtctcatcccttgggagcaagctgcccgcctcctggaggctcaagtggccacaggagggatcattgaccccaccagccaccaccacctccccatgccagtggccattcagcgtggctatgttgaccaggagatggagacagccttgtccagctcctccgagaccttccccacaccggacggccaggggcgcacgagctatgcccagctcctggaggagtgccccagggatgagacttctggccttcacctcctgcccctgccagaaagtgctcctgccctccccaccgaggagcaggtccagaggagcctgcaggccgtgccgggggccaaggatggcacatccctctgggacctgctcagctcctgccacttcaccgaggagcaacggaggggcctgctggaggacgtgcaggaggggaggaccactgtgccacagctgctagcctctgtgcagaggtgggtacaggagaccaagcttctggcccaggcccgcgtcatggtgcccggcccacggggtgaggtacccgctgtctggctgctggatgctggcatcatcacccaggagacccttgaggccctggctcagggcacgcagtcgcccgcccaggtcgccgagcagccggcggtgaaggcctgcctgtggggcacaggctgcgtggccggtgtgctgctacagccctctggggccaaggccagcatcgcccaggccgtgagggatggcctcctgcccacaggcctgggccagaggctgctggaagcccaggtggcatctggcttccttgttgaccccctgaacaaccagagactgtcagtggaggacgcggttaaggtcggcctggtgggcagggagctgagtgagcagctcgggcaggccgagagggcggcggccgggtacccagatccctactctagggcctccctctctctgtggcaggccatggagaaggggctcgtgccacagaacgagggcttgcccctcctgcaggtgcagctggccacagggggtgtggtggaccctgtccacggggtgcacctgccccaggcggcagcctgcagactcggccttctggacacacagacgagccaggtgctgactgcagttgacaaggacaacaagttcttctttgaccccagtgcgcgggaccaggtgacctaccagcagctcagggagcgctgcgtgtgcgactccgagaccggattgttgctgttgccactgccttcagacacagtgcttgaggtggacgaccacaccgcggtggctctgagggccatgaaggtgcccgtcagcacagggaggtttaaggggtgtagcgtgtcactctgggacctgctgctctccgaatacgttggcgctgacaagcggcgggagctggtggcactctgtcggtctgggagggctgcggccctgcggcaggtggtcagcgcagtcaccgccctggtcgaggctgcagagaggcagcccctgcaggccaccttcagagggctccggaagcaggtgtcagccagggacctgttcagggcgcagctgatcagcaggaagacgctggacgagctgagccaggggacaacgactgtgaaggaggtggcggagatggacagcgtgaagcggtccctggagggaggcaacttcattgccggggtccttatccagggcacccaggagaggatgagcatcccagaggccctgaggaggcacatcctgcggcctggcacagccctggtgctgctggaggcacaggcagctaccggcttcatcatcgaccccgcggagaaccggaagctgaccgtggaggaggcgttcaaagcaggaatgttcgggaaagaaacctacgtgaagctgctgtcggccgagcgcgccgtcaccggctacaccgacccctataccgggcagcagatctccctcttccaggccatgcagaaggacctcatcgtccgggagcacggcatccgcctgctggaggcccagatcgccacgggcggcatcatcgaccccgtgcacagccaccgcgtgcccgtggacgtggcctaccgctgcggctacttcgacgaggagatgaaccgcatcctggcggaccccagcgacgacaccaagggcttcttcgaccccaacacgcacgagaacctcacgtacctgcagcttctggagcgctgtgtggaggaccccgagacgggcctgtacctgctacaaatcataaagaaaggagaaaactacgtgtacatcaatgaggccacgagacacgtgttgcaatccagaactgcaaaaatgcgcgtggggaggtttgctgaccaggtggtctctttctgggacctgctgtcctctccatacttcacagaggacaggaagcgggagctcatccaggagtatggagcccagagtgggggcctggagaaattgctggaaatcatcaccacgacaattgaagaaacagagacgcaaaaccaaggcatcaaagtggcggccatcagaggggaggtgacagctgcagacctgttcaactccagggtcatcgatcagaagaccctgcacacacttcgtgtggggaggactgggggacaggcactcagcacgctggagtgtgtgaagccctatctggaaggcagcgactgcattgcgggggtcacggtgccctccaccagggaggtcatgagcctccatgaggccagcaggaaggagctcatccctgcagcatttgcgacttggctgctggaggcgcaggccgccaccgggttcctcctggacccctgcacccgccagaagctctctgtggatgaggctgtggatgtgggcctggtgaacgaggagctgcgggagaggctcctgaaggctgaaagagctgccacgggctacagggatccggccacaggagacacgatcccgctgttccaggccatgcagaagcagctcatcgagaaggcggaggcactgaggctgctggaggtgcaggtggccacggggggtgtcatcgacccacagcaccaccaccggctcccactggaaacagcctacagacggggctgtctgcacaaggacatctatgcgctcatttccgaccagaagcacatgaggaaacggtttgtggacccgaacacgcaagagaaggtctcgtaccgagagctgcaggagaggtgccgcccacaagaggacacgggctgggtgctgttcccagtgaacaaggctgcacgggactccgagcacatcgatgacgagacgagaagggccctggaggcagagcaagtggaaatcacagtgggaaggttcagaggccagaaaccaacactgtgggcactactgaattccgaatacgtgacagaggagaagaagctccagctggtgaggatgtatagaacacacaccagacgggcactgcagacggtagcgcagctcatcttagagttgatcgagaagcaggaaaccagcaacaaacacctgtggttccaaggaattagacgacagatcacagcttctgaactcctcagctcagccataatcacggaggaaatgctccaggacctggaaacgggacggagcacgacgcaagagctcatggaggacgaccgcgtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggagcccgtgcccgcgggcgtggtgggcagcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggtttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaagcccccggggcccggccgcagctccaggacgccaggcgcggcccgcgggagccagggccagccgggcgaggggacggcgactcggggcgctcccagcgagagggccagggggagggcgagacccaggaggccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggtttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggtttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgagcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcagggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccaccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgtgtcctggccgaccccagcgacgacaccaagggcttcttcgaccccaacacgcacgagaacctcacgtacgtgcagctgctgcgccgctgcgtgcccgacccggacaccgggctctacatgctgcagctggcaggccggggctccgccgtgcaccagctgagcgaggagctgcgctgtgccctgcgcgacgcccgcgtgacgccaggctcgggcgccctccagggccagagcgtctccgtctgggagctcctcttctaccgcgaggtgtccgaggaccggcgccaggacctgctgagcagataccgggcgggcacgctgaccgtggaggagctgggcgccaccctcacctcgctgctggcccaggcccaggcccaggcccgggccgaggccgaggccgggagcccgcgcccagacccccgggaggccctgcgtgcggccaccatggaggtcaaggtgggccgcctccgggggcgcgcggtgcccgtgtgggacgtgctggcgtccggctacgtgagcggggccgcccgggaggagctgctggccgagtttggctcggggaccctggacttgcccgcgctgacccgccggctgaccgccatcatcgaggaggccgaggaggcccccggggcccggccgcagctccaggacgcctggcgcggcccgcgggagccagggccagccgggcgaggggacggcgactcggggcgctcccagcgagagggccagggggagggcgagacccaggaggccgccgccgccgccgccgccgcccgccgccaggagcagaccctgcgtgatgccaccatggaggtgcagcgcgggcagttccaggggcggccggtctccgtgtgggacgtcctcttctcctcgtacctgagcgaggcccgccgagacgagctcctggcccagcacgcggccggcgccctgggcctgcccgacctcgtcgccgtcctcacccgggtcatcgaggagacggaggagcggctcagcaaggtgtccttccgcggcctgaggcgccaggtgtccgcctccgagctgcacacgtccgggatcctgggccccgagaccctgcgggacctggcccagggcactaagacgctgcaggaggtgacggagatggactcggtcaagcgctacctggagggcaccagctgcatcgcgggcgtcctggtgcccgccaaggaccagcccggccgccaggagaagatgagcatctaccaggccatgtggaagggcgtgctgcggcccggcacggccctggtgctgctggaggcgcaggcggccaccggcttcgtcatcgaccccgtgcgcaacctgaggctgtcggtggaggaggccgtggccgcgggcgtggtgggcggcgagatccaggagaagctgctgtcggccgagcgcgccgtcaccggctacaccgacccctacaccgggcagcagatctccctcttccaggccatgcagaaggacctcatcgtccgggagcacggcatccgcctgctggaggcccagatcgccacgggcggcgtcatcgaccccgtgcacagccaccgcgtgcccgtggacgtggcctaccggcgcggctacttcgacgaggagatgaaccgcgtcctggccgaccccagcgacgacaccaagggcttcttcgaccccaacacgcacgagaacctcacgtacctgcagcttctgcagagggccaccctggaccctgagacggggctcctatttctttctctctctctacagtgactgggcttcctccgtgcagttttctgcaactctggagaagttgaggcatacttgtgtgtctgggttgtttttttttttttttgtcattctttaattttgttgttttacccattcgttatctgtggaaaacgttttaagttgtcatgtgacagaaacttttcctttgtccatcgaggtgtttcataagttttttggtgtgttttctgggtcgtctatgtgtcatatggttttacttttctcccggaatt

SEQ ID NO: 373 - DNA, 5191 bp, Homo sapiens
ggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtgtggggtcctgctttcttctgctgagacagtgacgctttccagtttccaccctaatcagccactgctggtcacagccccacagccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcac

SEQ ID NO: 374 - DNA, 5108 bp, Homo sapiens
ggcgagtgcgtcgagctcgccgcggactcaagatggcggcgtgtggacgtgtacggaggatgttccgcttgtcggcggcgctgcatctgctgctgctattcgcggccggggccgagaaactccccggccagggcgtccacagccagggccagggtcccggggccaactttgtgtccttcgtagggcaggccggaggcggcggcccggcgggtcagcagctgccccagctgcctcagtcatcgcagcttcagcagcaacagcagcagcagcaacagcaacagcagcctcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttggtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaaatttttttaaagaaaaaaatgtatatagtaacgcatctcctccaggcttgatttgggcaatggggttatgtctttcatatgactgtgtaaaacaaagacaggacttggaggggaagcacaccacccagtgtgccatgactgaggtgtctcgttcatctctcagaagcaccttggggcctcgccagggccgtggtcttcaccgaggcgtgggtgggcagccgttccccaggctgtccatgggtatttctgtggtctcctcgcttcattgaagcaaagcatgagccttcctagacaagggcagctggggaggggaagggaccggaagtttgtgaagttgaacagtccatccatctgcactgagaggctggatcctgagtcccggggcagcaggatcccaggaaccttcctcctccagggcagcacaggactcagccatgtctggaccggccctgctgaggctacagtcactctggaagctctgcgcttcatcaggaggcaggactgtggcgggaggggtccttgaagatgggtgtggggagcagtgggtcaggaagtgggagccagaggtttgactcactttgctttatttttcaggctacaatacaggtcagagacaatggcttataaaggtttagtgtggtctcaggatgtgacaggcagtccagcctgacctttctgcacactccagacaaacttcccagacaagctcctttgtgcctctacgtggagagggtgtggaaagttatcacattaaaagatggaggatttgctctgttttttttctttctgtccatttgctgcgtgtacccactctagtaggcattggctaaatgttgtattttggcgattcatcaacctttgcagaatatgggctttatagaagcaatattcttggccatcccgcctcattcctccagtgtggagatgacaagtctgggtgtgagagggaggggtccgggcatcatggttcagcgtggcactcctttggttgagtttggggcatgagatcacagtggctgcacaagagagcagtgtgtacagtaggagagacatttatgtaatatatattttattaacctgttagatgtccacaaagtattataaatcacgtgcctaaaactgtccatgtagaccaaggcctgccctcggcgccccccactcttgcctctgctctgcac

SEQ ID NO: 375 - DNA, 3901 bp, Homo sapiens
aagatggcggcgtgtggacgtgtacggaggatgttccgcttgtcggcggcgctgcatctgctgctgctattcgcggccggggccgagaaactccccggccatggcgtccacagccagggccagggtcccggggccaactttgtgtccttcgtagggcaggccggaggcggcggcccggcgggtcagcagctgccccagctgcttcagtcatcgcagcttcagcagcaacagcagcagcagcaacagcaacagcagcttcagccgccgcagccgcctttcccggcgggtgggcctccggcccggcggggaggagcgggggctggtgggggctggaagctggcggaggaagagtcctgcagggaggacgtgacccgcgtgtgccctaagcacacctggagcaacaacctggcggtgctcgagtgcctgcaggatgtgagggagcctgaaaatgaaatttcttcagactgcaatcatttgttgtggaattataagctgaacctaactacagatcccaaatttgaatctgtggccagagaggtttgcaaatctactataacagagattaaagaatgtgctgatgaaccggttggaaaaggttacatggtttcctgcttagtggatcaccgaggcaacatcactgagtatcagtgtcaccagtacattaccaagatgacggccatcatttttagtgattaccgtttaatctgtggcttcatggatgactgcaaaaatgacatcaacattctgaaatgtggcagtattcggcttggagaaaaggatgcacattcacaaggtgaggtggtatcatgcttggagaaaggcctggtgaaagaagcagaagaaagagaacccaagattcaagtttctgaactctgcaagaaagccattctccgggtggctgagctgtcatcggatgactttcacttagaccggcatttatattttgcttgccgagatgatcgggagcgtttttgtgaaaatacacaagctggtgagggcagagtgtataagtgcctctttaaccataaatttgaagaatccatgagtgaaaagtgtcgagaagcacttacaacccgccaaaagctgattgcccaggattataaagtcagttattcattggccaaatcctgtaaaagtgacttgaagaaataccggtgcaatgtggaaaaccttccgcgatcgcgtgaagccaggctctcctacttgttaatgtgcctggagtcagctgtacacagagggcgacaagtcagcagtgagtgccagggggagatgctggattaccgacgcatgttgatggaagacttttctctgagccctgagatcatcctaagctgtcggggggagattgaacaccattgttccggattacatcgaaaagggcggaccctacactgtctgatgaaagtagttcgaggggagaaggggaaccttggaatgaactgccagcaggcgcttcaaacactgattcaggagactgaccctggtgcagattaccgcattgatcgagctttgaatgaagcttgtgaatctgtaatccagacagcctgcaaacatataagatctggagacccaatgatcttgtcgtgcctgatggaacatttatacacagagaagatggtagaagactgtgaacaccgtctcttagagctgcagtatttcatctcccgggattggaagctggaccctgtcctgtaccgcaagtgccagggagacgcttctcgtctttgccacacccacggttggaatgagaccagtgaatttatgcctcagggagctgtgttctcttgtttatacagacacgcctaccgcactgaggaacagggaaggaggctctcacgggagtgccgagctgaagtccaaaggatcctacaccagcgtgccatggatgtcaagctggatcctgccctccaggataagtgcctgattgatctgggaaaatggtgcagtgagaaaacagagactggacaggagctggagtgccttcaggaccatctggatgacttggtggtggagtgtagagatatagttggcaacctcactgagttagaatcagaggatattcaaatagaagccttgctgatgagagcctgtgagcccataattcagaacttctgccacgatgtggcagataaccagatagactctggggacctgatggagtgtctgatacagaacaaacaccagaaggacatgaacgagaagtgtgccatcggagttacccacttccagctggtgcagatgaaggattttcggttttcttacaagtttaaaatggcctgcaaggaggacgtgttgaagctttgcccaaacataaaaaagaaggtggacgtggtgatctgcctgagcacgaccgtgcgcaatgacactctgcaggaagccaaggagcacagggtgtccctgaagtgccgcaggcagctccgtgtggaggagctggagatgacggaggacatccgcttggagccagatctatacgaagcctgcaagagtgacatcaaaaacttctgttccgctgtgcaatatggcaacgctcagattatcgaatgtctgaaagaaaacaagaagcagctaagcacccgctgccaccaaaaagtatttaagctgcaggagacagagatgatggacccagagctagactacaccctcatgagggtctgcaagcagatgataaagaggttctgtccggaagcagattctaaaaccatgttgcagtgcttgaagcaaaataaaaacagtgaattgatggatcccaaatgcaaacagatgataaccaagcgccagatcacccagaacacagattaccgcttaaaccccatgttaagaaaagcctgtaaagctgacattcctaaattctgtcacggtatcctgactaaggccaaggatgattcagaattagaaggacaagtcatctcttgcctgaagctgagatatgctgaccagcgcctgtcttcagactgtgaagaccagatccgaatcattatccaggagtccgccctggactaccgcctggatcctcagctccagctgcactgctcagacgagatctccagtctatgtgctgaagaagcagcagcccaagagcagacaggtcaggtggaggagtgcctcaaggtcaacctgctcaagatcaaaacagaattgtgtaaaaaggaagtgctaaacatgctgaaggaaagcaaagcagacatctttgttgacccggtacttcatactgcttgtgccctggacattaaacaccactgcgcagccatcacccctggccgcgggcgtcaaatgtcctgtctcatggaagcactggaggataagcgggtgaggttacagcccgagtgcaaaaagcgcctcaatgaccggattgagatgtggagttacgcagcaaaggtggccccagcagatggcttctctgatcttgccatgcaagtaatgacgtctccatctaagaactacattctctctgtgatcagtgggagcatctgtatattgttcctgattggcctgatgtgtggacggatcaccaagcgagtgacacgagagctcaaggacaggtagagccaccttgaccaccaaaggaactacctatccagtgcccagtttgtacagccctcttgtatagcatccccactcacctcgctcttctcagaagtgacaccaaccccgtgttagagcattagcagatgtccactgcgttgtcccatccagcctccactcgtgtccatggtgtcctcctcctcctcaccgtgcagcagcagcagctggtcgctggggttactgcctttgtttggcaaacttgggtttacctgcctgtagacaagtctctctcataccaacagaacttccggtacttccagaaccaactcacctgacctgcaactcaaaggcttttttaagaaaaccaccaaaaaaaaaa

SEQ ID NO: 376 - DNA, 1694 bp, Homo sapiens
ccttgctgggctattggcgcccccagggctgcagctcgcccggcctccgcagtgccaggtcgacccccagcgcctacacccacgcgggttcagacctgccgagcgcccgccgccgcgggaggggcttgaggccggggcggggcggggccggggcggggcgtccccctcgtaggctccgggccgcgcattctcagcgctgggagccgccgcccccgcagctgccgccgccgccagggcccggactcggacgcgtggtagccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagatggacgagctcgctgtgctggtaacaga

SEQ ID NO: 377 - DNA, 1938 bp, Homo sapiens
agggccgggtcgccacagcccagggcctctggctaggctggtcgccgtcttacctccgggcccgcctcccgcccagctcctccgtccttggacgggatgggcccttgctgggctattggcgcccccagggctgcagctcgcccggcctccgcagtgccaggtcgacccccagcgcctacacccacgcgggttcagacctgccgagcgcccgccgccgcgggaggggcttgaggccggggcggggcggggccggggcggggcgtccccctcgtaggctccgggccgcgcattctcagcgctgggagccgccgcccccgcagctgccgccgccgccagggcccggactcggacgcgtggtaggctgtagctgccgctgtttgtgggggaagggccagtgatgggtctggagcgaaggccaagagtggggcacctgggggaagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagatggacgagctcgctgtgctggtaacaga

SEQ ID NO: 378 - DNA, 1805 bp, Homo sapiens
ctccgggcccgcctcccgcccagctcctccgtccttggacgggatgggcccttgctgggctattggcgcccccagggctgcagctcgcccggcctccgcagtgccaggtcgacccccagcgcctacacccacgcgggttcagacctgccgagcgcccgccgccgcgggaggggcttgaggccggggcggggcggggccggggcggggcgtccccctcgtaggctccgggccgcgcattctcagcgctgggagccgccgcccccgcagctgccgccgccgccagggcccggactcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaagcgctaccaccagccgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcagatggacgagctcgctgtgctggtaacaga

SEQ ID NO: 379 - DNA, 1486 bp, Homo sapiens
tcggacgcgtggtagcctagagtcctggggagcttctgtccacctgtcctgcagaggagtcgtttccagcccggctgccccaggatgggtgagttcaacgagaagaagacaacatgtggcaccgtttgcctcaagtacctgctgtttacctacaattgctgcttctggctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctgtacttcatcctgctcctcatcatctttctgctggagatcatcgctggtatcctcgcctacgcctactaccagcagctgaacacggagctcaaggagaacctgaaggacaccatgaccaggcgctaccaccagtcgggccatgaggctgtgaccagcgctgtggaccagctgcagcaggagttccactgctgtggcagcaacaactcacaggactggcgagacagtgagtggatccgctcacaggaggccggtggccgtgtggtcccagacagctgctgcaagacggtggtggctctttgtggacagcgagaccatgcctccaacatctacaaggtggagggcggctgcatcaccaagttggagaccttcatccaggagcacctgagggtcattggggctgtggggatcggcattgcctgtgtgcaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttcgtgcgcaccaatgcccagcaggggaggtgaggggggctggcggggcgaagtttggggggtgttttgtggggctccccggacatactctctgcctggtggtcagatgcaggttggaaggggccttgctgagtggcgcaaggccgagatcgttcccagcagggggagaaacccttcacaccccaggcccttcaggaactggggctttgccttgcagccacatggccccatcccagttggggaagccaggtgagctctgacccttgggcctgggcctctgcccctcccaacccagccgtcgtctccctcgacagcgcccctgctgtcttccccaccgcagtcaccaccacccgaaatgccacgtggtcactgtgcactgccctgttcatgtgcctctgcggggcagggccttcctggttttgtacactgctgtacccagatgcctacaaccatccctgccacatacaggtgctcaataaacacttgtagagcag

SEQ ID NO: 380 - DNA, 2902 bp, Homo sapiens
agcttccgctaaacgggctcagagccacgcggcacgcccgggaggctttctctggctggtaaccgctactcccggacaccagaccaccgccttccgtacacaggggcccgcatcccaccctcccggacctaagagcctgggtcccctgtttccggaggtccgcttcccggcccccagattctggcatcccagccctcagtgtccaagacccaggcagcccgggtccccgcctcccggatccaggcgtccgggatctgcgccaccagaacctagcctcctgcagacctccgccatctgggggcactcaacctcctggagccaagggccccacgtcccacccagagaaactctcgtattcccagctcctagggccaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgtgtgtgtgtgtgtgtgttctgtgacctcctgtccccatggtacgtcccaccctgtccccagatcccctattccctccacaataacagaaacactcccagggactctggggagaggctgaggacaaatacctgctgtcactccagaggacattttttttagcaataaaattgagtgtcaactatttaa

SEQ ID NO: 381 - DNA, 2476 bp, Homo sapiens
ggcccgcatcccaccctcccggacctaagagcctgggtcccctgtttccggaggtccgcttcccggcccccagattctggcatcccagccctcagtgtccacaaggaacccgggcgctccgaactcccagctttcggacatctggcacacggggcagagcagagaagcctcagcgcccagcctggggaatttaaacactccagcttccaagagccaaggaacttcagtgctgtgaactcacaactctaaggagccctccaaagttccagtctccaggtgctgttactcaactcagtcctaggaacgtcgggtcctgggaaggagcccaagcgctcccagccagcttccaggcgctaagaaaccccggtgcttcccatcatggtggccgatcctcctcgagactccaaggggctcgcagcggcggagcccaccgccaacgggggcctggcgctggcctccatcgaggaccaaggcgcggcagcaggcggctactgcggttcccgggaccaggtgcgccgctgccttcgagccaacctgcttgtgctgctgacagtggtggccgtggtggccggcgtggcgctgggactgggggtgtcgggggccgggggtgcgctggcgttgggcccggagcgcttgagcgccttcgtcttcccgggcgagctgctgctgcgtctgctgcggatgatcatcttgccgctggtggtgtgcagcttgatcggcggcgccgccagcctggaccccggcgcgctcggccgtctgggcgcctgggcgctgctctttttcctggtcaccacgctgctggcgtcggcgctcggagtgggcttggcgctggctctgcagccgggcgccgcctccgccgccatcaacgcctccgtgggagccgcgggcagtgccgaaaatgcccccagcaaggaggtgctcgattcgttcctggatcttgcgagaaatatcttcccttccaacctggtgtcagcagcctttcgctcatactctaccacctatgaagagaggaatatcaccggaaccagggtgaaggtgcccgtggggcaggaggtggaggggatgaacatcctgggcttggtagtgtttgccatcgtctttggtgtggcgctgcggaagctggggcctgaaggggagctgcttatccgcttcttcaactccttcaatgaggccaccatggttctggtctcctggatcatgtggtacgcccctgtgggcatcatgttcctggtggctggcaagatcgtggagatggaggatgtgggtttactctttgcccgccttggcaagtacattctgtgctgcctgctgggtcacgccatccatgggctcctggtactgcccctcatctacttcctcttcacccgcaaaaacccctaccgcttcctgtggggcatcgtgacgccgctggccactgcctttgggacctcttccagttccgccacgctgccgctgatgatgaagtgcgtggaggagaataatggcgtggccaagcacatcagccgtttcatcctgcccatcggcgccaccgtcaacatggacggtgccgcgctcttccagtgcgtggccgcagtgttcattgcacagctcagccagcagtccttggacttcgtaaagatcatcaccatcctggtcacggccacagcgtccagcgtgggggcagcgggcatccctgctggaggtgtcctcactctggccatcatcctcgaagcagtcaacctcccggtcgaccatatctccttgatcctggctgtggactggctagtcgaccggtcctgtaccgtcctcaatgtagaaggtgacgctctgggggcaggactcctccaaaattacgtggaccgtacggagtcgagaagcacagagcctgagttgatacaagtgaagagtgagctgcccctggatccgctgccagtccccactgaggaaggaaaccccctcctcaaacactatcgggggcccgcaggggatgccacggtcgcctctgagaaggaatcagtcatgtaaaccccgggagggaccttccctgccctgctgggggtgctctttggacactggattatgaggaatggataaatggatgagctagggctctgggggtctgcctgcacactctggggagccaggggccccagcaccctccaggacaggagatctgggatgcctggctgctggagtacatgtgttcacaagggttactcctcaaaacccccagttctcactcatgtccccaactcaaggctagaaaacagcaagatggagaaataatgttctgctgcgtccccaccgtgacctgcctggcctcccctgtctcagggagcaggtcacaggtcaccatggggaattctagcccccactggggggatgttacaacaccatgctggttattttggcggctgtagttgtggggggatgtgtgtgtgcacgtgtgtgtgtgtgtgtgtgtgttgttctgtgacctcctgtccccatggtacgt

SEQ ID NO: 382 - DNA, 5010 bp, Homo sapiens
ggcggctcgggacggaggacgcgctagtgtgagtgcgggcttctagaactacaccgaccctcgtgtcctcccttcatcctgcggggctggctggagcggccgctccggtgctgtccagcagccatagggagccgcacggggagcgggaaagcggtcgcggccccaggcggggcggccgggatggagcggggccgcgagcctgtggggaaggggctgtggcggcgcctcgagcggctgcaggttcttctgtgtggcagttcagaatgatggatcaagctagatcagcattctctaacttgtttggtggagaaccattgtcatatacccggttcagcctggctcggcaagtagatggcgataacagtcatgtggagatgaaacttgctgtagatgaagaagaaaatgctgacaataacacaaaggccaatgtcacaaaaccaaaaaggtgtagtggaagtatctgctatgggactattgctgtgatcgtctttttcttgattggatttatgattggctacttgggctattgtaaaggggtagaaccaaaaactgagtgtgagagactggcaggaaccgagtctccagtgagggaggagccaggagaggacttccctgcagcacgtcgcttatattgggatgacctgaagagaaagttgtcggagaaactggacagcacagacttcaccagcaccatcaagctgctgaatgaaaattcatatgtccctcgtgaggctggatctcaaaaagatgaaaatcttgcgttgtatgttgaaaatcaatttcgtgaatttaaactcagcaaagtctggcgtgatcaacattttgttaagattcaggtcaaagacagcgctcaaaactcggtgatcatagttgataagaacggtagacttgtttacctggtggagaatcctgggggttatgtggcgtatagtaaggctgcaacagttactggtaaactggtccatgctaattttggtactaaaaaagattttgaggatttatacactcctgtgaatggatctatagtgattgtcagagcagggaaaatcacctttgcagaaaaggttgcaaatgctgaaagcttaaatgcaattggtgtgttgatatacatggaccagactaaatttcccattgttaacgcagaactttcattctttggacatgctcatctggggacaggtgacccttacacacctggattcccttccttcaatcacactcagtttccaccatctcggtcatcaggattgcctaatatacctgtccagacaatctccagagctgctgcagaaaagctgtttgggaatatggaaggagactgtccctctgactggaaaacagactctacatgtaggatggtaacctcagaaagcaagaatgtgaagctcactgtgagcaatgtgctgaaagagataaaaattcttaacatctttggagttattaaaggctttgtagaaccagatcactatgttgtagttggggcccagagagatgcatggggccctggagctgcaaaatccggtgtaggcacagctctcctattgaaacttgcccagatgttctcagatatggtcttaaaagatgggtttcagcccagcagaagcattatctttgccagttggagtgctggagactttggatcggttggtgccactgaatggctagagggatacctttcgtccctgcatttaaaggctttcacttatattaatctggataaagcggttcttggtaccagcaacttcaaggtttctgccagcccactgttgtatacgcttattgagaaaacaatgcaaaatgtgaagcatccggttactgggcaatttctatatcaggacagcaactgggccagcaaagttgagaaactcactttagacaatgctgctttccctttccttgcatattctggaatcccagcagtttctttctgtttttgcgaggacacagattatccttatttgggtaccaccatggacacctataaggaactgattgagaggattcctgagttgaacaaagtggcacgagcagctgcagaggtcgctggtcagttcgtgattaaactaacccatgatgttgaattgaacctggactatgagaggtacaacagccaactgctttcatttgtgagggatctgaaccaatacagagcagacataaaggaaatgggcctgagtttacagtggctgtattctgctcgtggagacttcttccgtgctacttccagactaacaacagatttcgggaatgctgagaaaacagacagatttgtcatgaagaaactcaatgatcgtgtcatgagagtggagtatcacttcctctctccctacgtatctccaaaagagtctcctttccgacatgtcttctggggctccggctctcacacgctgccagctttactggagaacttgaaactgcgtaaacaaaataacggtgcttttaatgaaacgctgttcagaaaccagttggctctagctacttggactattcagggagctgcaaatgccctctctggtgacgtttgggacattgacaatgagttttaaatgtgatacccatagcttccatgagaacagcagggtagtctggtttctagacttgtgctgatcgtgctaaattttcagtagggctacaaaacctgatgttaaaattccatcccatcatcttggtactactagatgtctttaggcagcagcttttaatacagggtagataacctgtacttcaagttaaagtgaataaccacttaaaaaatgtccatgatggaatattcccctatctctagaattttaagtgctttgtaatgggaactgcctctttcctgttgttgttaatgaaaatgtcagaaaccagttatgtgaatgatctctctgaatcctaagggctggtctctgctgaaggttgtaagtggttcgcttactttgagtgatcctccaacttcatttgatgctaaataggagataccaggttgaaagacctctccaaatgagatctaagcctttccataaggaatgtagcaggtttcctcattcctgaaagaaacagttaactttcagaagagatgggcttgttttcttgccaatgaggtctgaaatggaggtccttctgctggataaaatgaggttcaactgttgattgcaggaataaggccttaatatgttaacctcagtgtcatttatgaaaagaggggaccagaagccaaagacttagtatattttcttttcctctgtcccttcccccataagcctccatttagttctttgttatttttgtttcttccaaagcacattgaaagagaaccagtttcaggtgtttagttgcagactcagtttgtcagactttaaagaataatatgctgccaaattttggccaaagtgttaatcttaggggagagctttctgtccttttggcactgagatatttattgtttatttatcagtgacagagttcactataaatggtgtttttttaatagaatataattatcggaagcagtgccttccataattatgacagttatactgtcggttttttttaaataaaagcagcatctgctaataaaacccaacagatactggaagttttgcatttatggtcaacacttaagggttttagaaaacagccgtcagccaaatgtaattgaataaagttgaagctaagatttagagatgaattaaatttaattaggggttgctaagaagcgagcactgaccagataagaatgctggttttcctaaatgcagtgaattgtgaccaagttataaatcaatgtcacttaaaggctgtggtagtactcctgcaaaattttatagctcagtttatccaaggtgtaactctaattcccatttgcaaaatttccagtacctttgtcacaatcctaacacattatcgggagcagtgtcttccataatgtataaagaacaaggtagtttttacctaccacagtgtctgtatcggagacagtgatctccatatgttacactaagggtgtaagtaattatcgggaacagtgtttcccataattttcttcatgcaatgacatcttcaaagcttgaagatcgttagtatctaacatgtatcccaactcctataattccctatcttttagttttagttgcagaaacattttgtggtcattaagcattgggtgggtaaattcaaccactgtaaaatgaaattactacaaaatttgaaatttagcttgggtttttgttacctttatggtttctccaggtcctctacttaatgagatagcagcatacatttataatgtttgctattgacaagtcattttaatttatcacattatttgcatgttacctcctataaacttagtgcggacaagttttaatccagaattgaccttttgacttaaagcagagggactttgtatagaaggtttgggggctgtggggaaggagagtcccctgaaggtctgacacgtctgcctacccattcgtggtgatcaattaaatgtaggtatgaataagttcgaagctccgtgagtgaaccatcatataaacgtgtagtacagctgtttgtcatagggcagttggaaacggcctcctagggaaaagttcatagggtctcttcaggttcttagtgtcacttacctagatttacagcctcacttgaatgtgtcactactcacagtctctttaatcttcagttttatctttaatctcctcttttatcttggactgacatttagcgtagctaagtgaaaaggtcatagctgagattcctggttcgggtgttacgcacacgtacttaaatgaaagcatgtggcatgttcatcgtataacacaatatgaatacagggcatgcattttgcagcagtgagtctcttcagaaaacccttttctacagttagggttgagttacttcctatcaagccagtacgtgctaacaggctcaatattcctgaatgaaatatcagactagtgacaagctcctggtcttgagatgtcttctcgttaaggagtagggccttttggaggtaaaggtata

SEQ ID NO: 383 - DNA, 3433 bp, Homo sapiens
gaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatg

SEQ ID NO: 384 - DNA, 6130 bp, Homo sapiens
gaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacgtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatatattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatgggagtataaattggacagtaaggttttgtcttaataaaatgaaatttgtttctcatgatatgaatcttgcaggtaagatgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattctttcagtatttttcatcatgttgggctcctagattgtactggggttgcccataaatcaaaccccatactcttagaattcattatattatggtgatatccgaacctagtgaatggtatgcttgggtgttttccattgagagtggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactattttatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcagctgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgta

SEQ ID NO: 385 - DNA, 3208 bp, Homo sapiens
cccgtgattcattcacagcggcagacgagcgccaggaaagggttatttgatctgatccctcaagttccggaggcagcagtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaagatgatgtgatgccagccacttactgtgaaattgatttagataaagaaaagagagatgcatttgtatatgccataaaaaatcattactggtaccagatgtacatagatgatttaccaatatggggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaaaatggaaaaagtcagatgtgaaatttgaagatcgatttgacaaatatcttgatccgtccttttttcaacatcggattcattggttttcaattttcaactccttcatgatggtgatcttcttggtgggcttagtttcaatgattttaatgagaacattaagaaaagattatgctcggtacagtaaagaggaagaaatggatgatatggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagaggggatcaatgctcagtacagccatatttgtctatgctgctacgtctccagtgaatggttattttggaggaagtctgtatgctagacaaggaggaaggagatggataaagcagatgtttattggggcattccttatcccagctatggtgtgtggcactgccttcttcatcaatttcatagccatttattaccatgcttcaagagccattccttttggaacaatggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggttcatggagcctgcggttattgtttgcctgggtggaattttaccttttggttcaatctttattgaaatgtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggcaatggacaagttttctctctgctgcatcaactgcaatctatgtttacatgtattccttttactactattttttcaaaacaaagatgtatggcttatttcaaacatcattttactttggatatatggcggtatttagcacagccttggggataatgtgtggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatg

SEQ ID NO: 386 - DNA, 6850 bp, Homo sapiens
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatcctttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaagctaaaaatagctttatttatgctgaattgtgatttttttatgccaaattttttttagttctaatcattgatgatagcttggaaataaataattatgccatggcatttgacagttcattattcctataagaattaaattgagtttagagagaatggtggtgttgagctgattattaacagttactgaaatcaaatatttatttgttacattattccatttgtattttaggtttccttttacattctttttatatgcattctgacattacatattttttaagactatggaaataatttaaagatttaagctctggtggatgattatctgctaagtaagtctgaaaatgtaatattttgataatactgtaatatacctgtcacacaaatgcttttctaatgttttaaccttgagtattgcagttgctgctttgtacagaggttactgcaataaaggaagtggattcattaaacct

SEQ ID NO: 387 - DNA, 6433 bp, Homo sapiens
tgccggtggcctctgtggccgtccaggctagcggcggcccgcaggcggcggggagaaagactctctcacctggtcttgcggctgtggccaccgccggccaggggtgtggagggcgtgctgccggagacgtccgccgggctctgcagttccgccgggggtcgggcagctatggagccgcggcccacggcgccctcctccggcgccccgggactggccggggtcggggagacgccgtcagccgctgcgctggccgcagccagggtggaactgcccggcacggctgtgccctcggtgccggaggatgctgcgcccgcgagccgggacggcggcggggtccgcgatgagggccccgcggcggccggggacgggctgggcagacccttggggcccaccccgagccagagccgtttccaggtggacctggtttccgagaacgccgggcgggccgctgctgcggcggcggcggcggcggcggcagcggcggcggctggtgctggggcgggggccaagcagacccccgcggacggggaagccagcggcgagagcgagccggctaaaggcagcgaggaagccaagggccgcttccgcgtgaacttcgtggacccagctgcctcctcgtcggctgaagacagcctgtcagatgctgccggggtcggagtcgacgggcccaacgtgagcttccagaacggcggggacacggtgctgagcgagggcagcagcctgcactccggcggcggcggcggcagtgggcaccaccagcactactattatgatacccacaccaacacctactacctgcgcaccttcggccacaacaccatggacgctgtgcccaggatcgatcactaccggcacacagccgcgcagctgggcgagaagctgctccggcctagcctggcggagctccacgacgagctggaaaaggaaccttttgaggatggctttgcaaatggggaagaaagtactccaaccagagatgctgtggtcacgtatactgcagaaagtaaaggagtcgtgaagtttggctggatcaagggtgtattagtacgttgtatgttaaacatttggggtgtgatgcttttcattagattgtcatggattgtgggtcaagctggaataggtctatcagtccttgtaataatgatggccactgttgtgacaactatcacaggattgtctacttcagcaatagcaactaatggatttgtaagaggaggaggagcatattatttaatatctagaagtctagggccagaatttggtggtgcaattggtctaatcttcgcctttgccaacgctgttgcagttgctatgtatgtggttggatttgcagaaaccgtggtggagttgcttaaggaacattccatacttatgatagatgaaatcaatgatatccgaattattggagccattacagtcgtgattcttttaggtatctcagtagctggaatggagtgggaagcaaaagctcagattgttcttttggtgatcctacttcttgctattggtgatttcgtcataggaacatttatcccactggagagcaagaagccaaaagggttttttggttataaatctgaaatatttaatgagaactttgggcccgattttcgagaggaagagactttcttttctgtatttgccatcttttttcctgctgcaactggtattctggctggagcaaatatctcaggtgatcttgcagatcctcagtcagccatacccaaaggaacactcctagccattttaattactacattggtttacgtaggaattgcagtatctgtaggttcttgtgttgttcgagatgccactggaaacgttaatgacactatcgtaacagagctaacaaactgtacttctgcagcctgcaaattaaactttgatttttcatcttgtgaaagcagtccttgttcctatggcctaatgaacaacttccaggtaatgagtatggtgtcaggatttacaccactaatttctgcaggtatattttcagccactctttcttcagcattagcatccctagtgagtgctcccaaaatatttcaggctctatgtaaggacaacatctacccagctttccagatgtttgctaaaggttatgggaaaaataatgaacctcttcgtggctacatcttaacattcttaattgcacttggattcatcttaattgctgaactgaatgttattgcaccaattatctcaaacttcttccttgcatcatatgcattgatcaatttttcagtattccatgcatcacttgcaaaatctccaggatggcgtcctgcattcaaatactacaacatgtggatatcacttcttggagcaattctttgttgcatagtaatgttcgtcattaactggtgggctgcattgctaacatatgtgatagtccttgggctgtatatttatgttacctacaaaaaaccagatgtgaattggggatcctctacacaagccctgacttacctgaatgcactgcagcattcaattcgtctttctggagtggaagaccacgtgaaaaactttaggccacagtgtcttgttatgacaggtgctccaaactcacgtccagctttacttcatcttgttcatgatttcacaaaaaatgttggtttgatgatctgtggccatgtacatatgggtcctcgaagacaagccatgaaagagatgtccatcgatcaagccaaatatcagcgatggcttattaagaacaaaatgaaggcattttatgctccagtacatgcagatgacttgagagaaggtgcacagtatttgatgcaggctgctggtcttggtcgtatgaagccaaacacacttgtccttggatttaagaaagattggttgcaagcagatatgagggatgtggatatgtatataaacttatttcatgatgcttttgacatacaatatggagtagtggttattcgcctaaaagaaggtctggatatatctcatcttcaaggacaagaagaattattgtcatcacaagagaaatctcctggcaccaaggatgtggtagtaagtgtggaatatagtaaaaagtccgatttagatacttccaaaccactcagtgaaaaaccaattacacacaaagttgaggaagaggatggcaagactgcaactcaaccactgttgaaaaaagaatccaaaggccctattgtgcctttaaatgtagctgaccaaaagcttcttgaagctagtacacagtttcagaaaaaacaaggaaagaatactattgatgtctggtggctttttgatgatggaggtttgaccttattgataccttaccttctgacgaccaagaaaaaatggaaagactgtaagatcagagtattcattggtggaaagataaacagaatagaccatgaccggagagcgatggctactttgcttagcaagttccggatagacttttctgatatcatggttctaggagatatcaataccaaaccaaagaaagaaaatattatagcttttgaggaaatcattgagccatacagacttcatgaagatgataaagagcaagatattgcagataaaatgaaagaagatgaaccatggcgaataacagataatgagcttgaactttataagaccaagacataccggcagatcaggttaaatgagttattaaaggaacattcaagcacagctaatattattgtcatgagtctcccagttgcacgaaaaggtgctgtgtctagtgctctctacatggcatggttagaagctctatctaaggacctaccaccaatcctcctagttcgtgggaatcatcagagtgtccttaccttctattcataaatgttctatacagtggacagccctccagaatggtacttcagtgcctagtgtagtaactgaaatcttcaatgacacattaacatcacaatggcgaatggtgacttttctttcacgatttcattaatttgaaagcacacaggaaagttgctccattgataacgtgtatggagacttcggttttagtcaattccatatctcaatcttaatggtgattcttctctgttgaactgaagtttgtgagagtagttttcctttgctacttgaatagcaataaaagcgtgttaactttttgattgatgaaagaagtacaaaaagcctttagccttgaggtgccttctgaaattaaccaaatttcatccatatatcctcttttataaacttatagaatgtcaaactttgccttcaactgtttttatttctagtctcttccactttaaaacaaaatgaacactgcttgtcttcttccattgaccatttagtgttgagtactgtatgtgttttgttaattctataaaggtatctgttagatattaaaggtgagaattagggcaggttaatcaaaaatggggaaggggaaatggtaaccaaaaagtaaccccatggtaaggtttatatgagtatatgtgaatatagagctaggaaaaaaagcccccccaaatacctttttaacccctctgattggctattattactatatttattattatttattgaaaccttagggaagattgaagattcatcccatacttctatataccatgcttaaaaatcacgtcattctttaaacaaaaatactcaagatcatttatatttatttggagagaaaactgtcctaatttagaatttccctcaaatctgagggacttttaagaaatgctaacagatttttctggaggaaatttagacaaaacaatgtcatttagtagaatatttcagtatttaagtggaatttcagtatactgtactatcctttataagtcattaaaataatgtttcatcaaatggttaaatggaccactggtttcttagagaaatgtttttaggcttaattcattcaattgtcaagtacacttagtcttaatacactcaggtttgaacagattattctgaatattaaaatttaatccattcttaatattttaaaacttttgttaagaaaaactgccagtttgtgcttttgaaatgtctgttttgacatcatagtctagtaaaattttgacagtgcatatgtactgttactaaaagctttatatgaaattattaatgtgaagtttttcatttataattcaaggaaggatttcctgaaaacatttcaagggatttatgtctacatatttgtgtgtgtgtgtgtatatatatgtaatatgcatacacagatgcatatgtgtatatataatgaaatttatgttgctggtattttgcattttaaagtgatcaagattcattaggcaaactttggtttaagtaaacatatgttcaaatcagattaacagatacaggtttcatagagaacaaaggtgatcatttgaagggcatgctgtaatttcacacaattttccagttcaaaaatggagaatacttcgcctaaaatactgttaagtgggttaattgatacaagtttctgtggtggaaaatttatgcaggttttcacgaatcctttttttttttttttttttttttgagacggagtctcgctctgttgccacgctggaatgcagtaacgtgatcttggctcactgcgacctccacctccccagttcaagcgattctcctgcctcagcctccctagtagctgggactacgggtgcacgccaccatgcccagctaatttttgtattttgagtagagacagggtttcaccgtgttggctaggatggtgtctatctcttgaccttgtgatccacccgcctcagcctcccagagtgctgggattacaggtgcgagccactgcgcctggctggttttcatgaatcttgatagacatctataacgttattattttcagtggtgtgcagcatttttgcttcatgagtatgacctaggtatagagatctgataacttgaattcagaatattaagaaaatgaagtaactgattttctaaaaaaaaaaaaaaaaaaaatttctacattataactcacagcattgttccattgcaggttttgcaatgtttgggggtaaagacagtagaaatattattcagtaaacaataatgtgtgaacttttaagatggataatagggcatggactgagtgctgctatcttgaaatgtgcacaggtacacttaccttttttttttttttttttaagtttttcccattcaggaaaacaacattgtgatctgtactacaggaaccaaatgtcatgcgtcatacatgtgggtataaagtacataaaatatatctaactattcataatgtggggtgggtaatactgtctgtgaaataatgtaagaagcttttcacttaaaaaaaatgcattactttcacttaacactagacaccaggtcgaaaattttcaaggttatagtacttatttcaacaattcttagagatgctagctagtgttgaattctaatcattgatgatagcttggaaataaataattatgccatggcatttgacagt

SEQ ID NO: 388 - DNA, 4769 bp, Homo sapiens
cgaccggtgcgcttgccagatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtatgcag

SEQ ID NO: 389 - DNA, 4712 bp, Homo sapiens
cgaccggtgcgcttgccagatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagataccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagttt

SEQ ID NO: 390 - DNA, 4911 bp, Homo sapiens
cgaccggtgcgcttgccagatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgtatgcag

SEQ ID NO: 391 - DNA, 4854 bp, Homo sapiens
cgaccggtgcgcttgccagatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagataccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagttt

SEQ ID NO: 392 - DNA, 4495 bp, Homo sapiens
aggtgaacaggtcctcacgcccagctccgccccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgcaattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggccagtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcgccgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccagcgccaaaacaagccaaagagcctcccaccagagccgggaggaaaaggcccctgcaatgtggtgacacctcccctttcacacctggatccatcttgagagccacagtcactggattgactttgctgtcaaaactactgacagggagcagcccccgggccgctggctggtgggcccccaattgacacccatgccagagaggtggggatcctgcctaaggttgtctacgggggcacttggaggacctggcgtgctcagacccaacagcaaaggaactagaaagaaggacccagaaggcttgctttcctgcatctctgtgaagcctctctccttggccacagactgaactcgcagggagtgcagcaggaaggaacaaagacaggcaaacggcaacgtagcctgggctcactgtgctggggcatggcgggatcctccacagagaggaggggaccaattctggacagacagatgttgggaggatacagaggagatgccacttctcactcaccactaccagccagcctccagaaggccccagagagaccctgcaagaccacggagggagccgacacttgaatgtagtaataggcagggggccctgccaccccatccagccagaccccagctgaaccatgcgtcaggggcctagaggtggagttcttagctatccttggctttctgtgccagcctggctctgcccctcccccatgggctgtgtcctaaggcccatttgagaagctgaggctagttccaaaaacctctcctgacccctgcctgttggcagcccactccccagccccagccccttccatggtactgtagcaggggaattccctccccctccttgtgccttctttgtatataggcttctcaccgcgaccaataaacagctcccagtttgt

SEQ ID NO: 393 - DNA, 2540 bp, Homo sapiens
ggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttatggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacccggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctgtcctctcttcctcttcccccaagattgagctctctgcccttgatcagccccaccctggcctagaccagcagacagagccaggagaggctcagctgcattccgcagcccccacccccaaggttctccaacatcacagcccagcccacccactgggtaataaaagtggtttgtggagtttctggctctgttctgtgggccaggagagggactaggttgctggggggtgatgggaccgtcctgttcagctggttcaggcttcagccaccctgttgagcaggttttcccatcgtctctctcgaaactggcctggcccc

SEQ ID NO: 394 - DNA, 2161 bp, Homo sapiens
ccaccgctgggtccccagcattaagccctggagcatgagcccagtgaactttgaaattcaggaaggaattcacaggaaagctgcggcgaggcgggcagaaaaccacaggcttccaagaaacgcgtgtctgccgccccctcctcccaccctgaggccagtcctagagcgaaggccctcctccgacgtcgtcaccaagcccaagggaagggtggcaggtgctcagcgggcagacgccccgccccgccccgccaggttctgttgggggcgaggcccgcgcaagccccgcctcttccccggcaccaggggcgggcccaggtgcgcccagggccggggagcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactgagtgcccgtgaactttcgccaaacca

SEQ ID NO: 395 - DNA, 1528 bp, Homo sapiens
aaggcggaagcgtgggagggggccgcggtggcccaggacctgctggctctggggtaaaagggtgtgcggtgaggctggtgggtgcaggaaggccaggtctgccccctggacgcggacgaaaagggattcccagtgacatccccgccccctcccgctgcctcggtccccacaggtatggaggtgtcccgggggcggcgtcgcggggcgcctcatgcccagacttcagggggctgtgcgtgcggctggcggcggagctggcgacgctgggcgccctcgagcagcagcgagaggcgggcgcggaggtgctgagcgccggcgacggccctggcgcggaggaggactttctgcggcagctcggcagcctgctgcgggagctgcactgcccggatcgcgcgctctgcggcggggatggcgcggctgcgcttcgggaacccggtgccggactgcgcctgctgcgctttctctgctcagagctccaagccacccgcctcctgtgcctccgctctctgctggatccgagtcctaggccaccccttggtgaaggggtagtggagggagccggcatggtccaagaactggaccttaccctccaagccctggggctgcccagacctgcaccagggacccccgccagccagctgctgcaggagttgcatgctaaggtagagaagctgcagccttctctgcccccagggtccctgcagcccctcctcagctgctcgctagatgcacccagatgggaagcgttggagtctctgtcccaaagcctcagagatcagtaccgctgccgccgctgcctcctcctcaagcgccttgacctcactacatctgctttccactggagtgaccgggcagaggcccaaggagaggccatgagggcagtgctgatcccaattcgagaggttctgaccccagaatcggacatctccattgcacacgttctggctgcccgagccgacctgtcttgtctcgtcccagccaccagcgtggctgtccgcagagggacctgctgtgccatcaacaaggtgcttatgggcaacgttccagaccgggggggccgcccaaatgagctggagcctcccatgcccacctggaggagccgaagagaggatggaggcccccagtgttggggtcgcaagaagaagaagaagaagtaaagggggactggtggtcgggggcggggggtcctccatgagatgctaatgctatcggtaatctctggggagtccgtttaaggctttccttggtatttggcacccaagccccccatctcctattcctgagtccccaaatgccctgctcccattcacgtcaataccaagaaccatgttctccagagaataaatttaatttatgacagctgtaggacctctctctgtgggggccaagtcaggggtgttggggtttgtgaaggggttgggggggtctctgctccctgggactgaatgggcccctgctgctcgaccctcaaagttctttgccctatagcacatctatcctgtgccgtgggcatgggtaaggagacatt

SEQ ID NO: 396 - DNA, 2953 bp, Homo sapiens
atgcttaaatacacgcactggaatgctgtgtctctgacaaacagaaatcaaatcagcacaaaggcagaccaagaggaagtttatcctcccacctacaaattccccagagagctttcatctagaaggtttgactctggccagacaaccagcgagcatcttctcgcaatctgttgcttcttccatggcaaactccagagaattaagaagccaaactcaacatcgccatgggcctcaggacgactaaacagatggggagaggcactaaagctcctggtcaccaagagggacttttcatccccgtggtcccacggtcctcccgcgccccggaggcctgccagccccgctcggacgctcgtttgcccctaacccgccgccatggcttcaccggacgaccctctgcgcgcagatcatatggtaaaggaaccagtggaagacacagaccctagcactttatcctttaatatgggagaagaaaatggctttccagatagcactggagatcctcttccagagatcagcaaggacaactcctgcaaagaaaactgtacttgttcctcctgcttgctccgggcccccaccataagtgacttgctcaatgatcaggacttactagacgtgatcaggataaagctggatccgtgtcacccaacggtgaaaaactggaggaattttgcaagcaaatgggggatgtcctatgacgaattgtgcttcctggagcagaggccacagagccccaccttggagttcttgctccggaacagtcagaggacggtgggccagctgatggagctctgcaggctctaccacagggccgacgtggagaaggttctgcgcaggtgggtggacgaggagtggcccaagcgggagcgtggagacccctccaggcacttctagagctcttcttcttccttcattggcctctccggatgttgaaacaaccacaggtcaagaaggaatgtgaatctgttgttttataagagtttaggacaaggacgtggaacagtggacactggttttccccaaagctggcagttttgtggaggggtagcttgtttcggtggtggatctctgtttatttttgcacatctgttataatttaatattcaaatctggaattaagaaaacatattttctagtatcctctaagggccaaagtcctacaatcggaatggattcatgccacgttgaagataaaattatcctctctctgaaatacggtaaagatttaaataggtcctgagactgttgatagccccagacatacccacagcattatatgtaacatctctcctgatcagtgccattcccacggtttcaaagaaaacagctacaaggaatgcttacctgagtgtctgcagcaccctccacttctctcctaggcaatgagacccagtggctagaaattcaccatgtctattctcaagatccatgccagggagctctttgactctcgtgggaatcccactgttgaggttgatctcttcacctcagaaggtctcttcagagctgctgtgcccagtggtgcttcaactggtatctatgaggtcctagagctccaggacaatgataagactcgctatatggggaagggtgtctcaaagcctgttgagcccatcaataaaactattgcacctgtcctggttagcaagaaactgaacgtcacagaacaagagaagattgacaaacttatgatagagatggatggaacagaaaataaatctaaatttggtgcaaatgccattctgggagtgtccctcgctgcctgcaaagctagtgctgttgagaagggggttcccctgtaccaccacatcgccgacttgtctggcaactccaaagtcatcttgccagtcccggtgttcaatgtcatcaatggcagttctcatgctgtcaccaagctggccatgcaggagttcatggtcctcccagtcggtgcagcaaacttcagggaagccatgcccattggagcggaggtttaccacagcctgaagaatgtcatcaaggagaaatatgggaaagatgccaccggtgtgggggatggaggcgcgtttgctcccaacatcctggagaataaagaaggcctggagctgctgaagactgcgattgggaaagctggctacactgataaggtgatcgtcagcatggacgtagaggcctccgagttcttcaggtctggaaagtatgacctggaattcaagtttctcgacgaccccaccaggtacatctcacctgactgtctggctgacctgtacaagtccttcatcaaaaactacccagtggtgtctactgaagatccctttgaccaggatgactggggagcttggcagaagttcacggccagtgcaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggcagcaaggctaagtttgccggcaggaacttcagaaaccccccagccaagtaagctgtgggcaggcaagcccttcagtcacctggtggctaattagacccctccccttgtgtcaactccggcagctcaagacccccgagcaacatttgtaggggccgctgctagttagctacccttgcccaccgccgtggagttcgcacctcttccttagaacttctacagaagcaggttgcagtgagccgagattgcgccactgcacaccagtctggagacagagtgagagtccgtcccag

SEQ ID NO: 397 - DNA, 1540 bp, Homo sapiens
aggtcacagagcgcggacacccgcggggcttaacaggcggggctatttttcgaggcggaagaatactcaagttgcaagagtggcaactttttcaagaaggggaaagtcccacttcgggccctttgggtttcttcgcagtcagatccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagct

SEQ ID NO: 398 - DNA, 1529 bp, Homo sapiens
aatgcgcagcctgagagggggtgagctgacactgtcccagctgccacctagactcggagctccatccaaacctccagcgaagacatcccaggtcgggtgaatcttccagccctgggggtggaggtagtaaaggccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagct

SEQ ID NO: 399 - DNA, 1461 bp, Homo sapiens
tgacactgtcccagctgccacctagactcggagctccatccaaacctccagcgaagacatcccagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaagaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagct

SEQ ID NO: 400 - DNA, 1652 bp, Homo sapiens
gcgccgagaatggccgttatgaggaccctaagaggtgagaccctctcgccttctggggtggggggtcccgtcctttcccccactgaggacagaggcccgcccagcgatctgagcatgtgtggacgtcaatcttgcagcccctcttccaggccccctccccagccttgcagggctcaggttacccctggcctttcctaaaggtcactcattcctcttgacgtttgcaaaaggggaatgtaatcctggggtgggccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaaggcaaaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagct

SEQ ID NO: 401 - DNA, 1656 bp, Homo sapiens
cgggcaactgagggacccactcacgtgcagccgccattcgcgccgcttccagggcaagcacccagtcagggcctctcgctgcgcgccctagaccgcgcccgcccccacccaagtccctccctcagggtccaaaccggagcagtgccccggaccgcgcaggcctcgcagtaccgtgatgttgacgaacgttttcccggggacggcggcccagacggagggcgagtccttgtagcccacgatggccgcgtcctgacagccatggccatgcagaaaatctttgcccgggaaatcttggactccaggggcaaccccacggtggaggtggacctgcacacggccaagggccgattccgagcagctgtgcccagtggggcttccacgggtatctatgaggctctggaactaagagacggagacaaaggccgctacctggggaaaggagtcctgaaggctgtggagaacatcaacaatactctgggccctgctctgctgcaaaaggcaaaaactaagcgttgtggatcaagaaaaagttgacaaatttatgattgagctagatgggaccgagaataagtccaagtttggggccaatgccatcctgggcgtgtccttggccgtgtgtaaggcgggagcagctgagaagggggtccccctgtaccgccacatcgcagatctcgctgggaaccctgacctcatactcccagtgccagccttcaatgtgatcaacgggggctcccatgctggaaacaagctggccatgcaggagttcatgattctgcctgtgggagccagctccttcaaggaagccatgcgcattggcgccgaggtctaccaccacctcaagggggtcatcaaggccaagtatgggaaggatgccaccaatgtgggtgatgaaggtggcttcgcacccaacatcctggagaacaatgaggccctggagctgctgaagacggccatccaggcggctggttacccagacaaggtggtgatcggcatggatgtggcagcatctgagttctatcgcaatgggaagtacgatcttgacttcaagtcgcctgatgatcccgcacggcacatcactggggagaagctcggagagctgtataagagctttatcaagaactatcctgtggtctccatcgaagacccctttgaccaggatgactgggccacttggacctccttcctctcgggggtgaacatccagattgtgggggatgacttgacagtcaccaaccccaagaggattgcccaggccgttgagaagaaggcctgcaactgtctgctgctgaaggtcaaccagatcggctcggtgaccgaatcgatccaggcgtgcaaactggctcagtctaatggctggggggtgatggtgagccaccgctctggggagactgaggacacattcattgctgaccttgtggtggggctctgcacaggacagatcaagactggcgccccctgccgctcggagcgtctggccaaatacaaccaactcatgaggatcgaggaggctcttggggacaaggcaatctttgctggacgcaagttccgtaacccgaaggccaagtgagaagctggaggctccaggactccactggacagacccaggtcttccagacctgcttcctgaaataaacactggtgccaaccaagacagct

SEQ ID NO: 402 - DNA, 2424 bp, Homo sapiens
acccgcgctcgtacgtgcgcctccgccggcagctcctgactcatcgggggctccgggtcacatgcgcccgcgcggccctataggcgcctcctccgcccgccgcccgggagccgcagccgccgccgccactgccactcccgctctctcagcgccgccgtcgccaccgccaccgccaccgccactaccaccgtctgagtctgcagtcccgagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatgtgtcacttgtgctttgctcttgtcccacgtgtcttccactttgcatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcctaaaactggcctgacttgggggaacgatgtgtctgtatttcatgtggctgtagatcccaagatgactggggtgggaggtcttgctagaatgggaagggtcatagaaagggccttgacatcagttcctttgtgtgtactcactgaagcctgcgttggtccagagcggaggctgtgtgcctgggggagttttcctctatacatctctccccaaccctaggttccctgttcttcctccagctgcaccagagcaacctctcactccccatgccacgttccacagttgccaccacctctgtggcattgaaatgagcacctccattaaagtctgaatcagtgca

SEQ ID NO: 403 - DNA, 2029 bp, Homo sapiens
cgccaccgccactaccaccgtctgagtctgcagtcccgagcctcccgccccgcccattgatctcaggctccacccctctaagcctcttatctttctccttccttcccttccacccgaggagatcccagccatcatgtccatagagaagatctgggcccgggagatcctggactcccgcgggaaccccacagtggaggtggatctctatactgccaaaggtcttttccgggctgcagtgcccagtggagcctctacgggcatctatgaggccctggagctgagggatggagacaaacagcgttacttaggcaaaggtgtcctgaaggcagtggaccacatcaactccaccatcgcgccagccctcatcagctcaggtctctctgtggtggagcaagagaaactggacaacctgatgctggagttggatgggactgagaacaaatccaagtttggggccaatgccatcctgggtgtgtctctggccgtgtgtaaggcaggggcagctgagcgggaactgcccctgtatcgccacattgctcagctggccgggaactcagacctcatcctgcctgtgccggccttcaacgtgatcaatggtggctctcatgctggcaacaagctggccatgcaggagttcatgatcctcccagtgggagctgagagctttcgggatgccatgcgactaggtgcagaggtctaccatacactcaagggagtcatcaaggacaaatacggcaaggatgccaccaatgtgggggatgaaggtggctttgcccccaatatcctggagaacagtgaagccttggagctggtgaaggaagccatcgacaaggctggctacacggaaaagatcgttattggcatggatgttgctgcctcagagttttatcgtgatggcaaatatgacttggacttcaagtctcccactgatccttcccgatacatcactggggaccagctgggggcactctaccaggactttgtcagggactatcctgtggtctccattgaggacccatttgaccaggatgattgggctgcctggtccaagttcacagccaatgtagggatccagattgtgggtgatgacctgacagtgaccaacccaaaacgtattgagcgggcagtggaagaaaaggcctgcaactgtctgctgctcaaggtcaaccagatcggctcggtcactgaagccatccaagcgtgcaagctggcccaggagaatggctggggggtcatggtgagtcatcgctcaggagagactgaggacacattcattgctgacctggtggtggggctgtgcacaggccagatcaagactggtgccccgtgccgttctgaacgtctggctaaatacaaccagctcatgagaattgaggaagagctgggggatgaagctcgctttgccggacataacttccgtaatcccagtgtgctgtgattcctctgcttgcctggagacgtggaacctctgtctcatcctcctggaaccttgctgtcctgatctgtgatagttcaccccctgagatcccctgagccccagggtgcccagaacttccctgattgacctgctccgctgctccttggcttacctgacctcttgctgtctctgctcgccctcctttctgtgccctactcattggggttccgcactttccacttcttcctttctctttctctcttccctcagaaactagaaatgtgaatgaggattattataaaagggggtccgtggaagaatgatcagcatctgtgatgggagcgtcagggttggtgtgctgaggtgttagagagggaccatatgagccgtgaactgtgcatagtgctgggatggaggggagtgttgggcatgtgatcacgcctggctaataaggctttagtgtatttatttatttatttattttatttgtttttcattcatcccattaatcatttccccataactcaatggcatcccaagatgactggggtgggaggtcttgctagaatgggaagggtcatagaaagggccttgacatcagttcctttgtgt

SEQ ID NO: 404 - DNA, 2803 bp, Homo sapiens
cgggtctgatagtccctacctgtcaggactggtgttaggatgagataatgtttgtgaactgtaaactatataaacgtgtgctactgtgagaactggacaaagaagagagggagtgagagaaattaagggagggctggggctgggaaagaacgaaaagggagtcgcgtatagaggagagcgcgacagtcgcgagccacactttgcaatgaaactctttagactttctgccgggagagcggcccagacgcgccaggtctgtagcaggaggccgcgccgagggcgggtccccagaagcctacaggtgagtatcggttctccccttcccggctttcggtccggaggaggcgggagcagcttccctgttctgatcctatcgcgggcggcgcagggccggcttggccttccgtgggacggggaggggggcgggatgtgtcacccaaataccagtggggacggtcggtggtggaaccagccgggcaggtcgggtagagtataagagccggagggagcggccgggcggcagacgcctgcagaccatcccagacgccggagcccgagccccgccgagtccccgcgcctcatccgcccgcgtccggtccgcgttcctccgccccacaatggctcggggccccggcctcgcgccgccaccgctgcggctgccgctgctgctgctggtgctggcggcggtgaccggccacacggccgcgcaggacaactgcacgtgtcccaccaacaagatgaccgtgtgcagccccgacggccccggcggccgctgccagtgccgcgcgctgggctcgggcatggcggtcgactgctccacgctgacctccaagtgtctgctgctcaaggcgcgcatgagcgcccccaagaacgcccgcacgctggtgcggccgagtgagcacgcgctcgtggacaacgatggcctctacgaccccgactgcgaccccgagggccgcttcaaggcgcgccagtgcaaccagacgtcggtgtgctggtgcgtgaactcggtgggcgtgcgccgcacggacaagggcgacctgagcctacgctgcgatgagctggtgcgcacccaccacatcctcattgacctgcgccaccgccccaccgccggcgccttcaaccactcagacctggacgccgagctgaggcggctcttccgcgagcgctatcggctgcaccccaagttcgtggcggccgtgcactacgagcagcccaccatccagatcgagctgcggcagaacacgtctcagaaggccgccggtgaagtggatatcggcgatgccgcctactacttcgagagggacatcaagggcgagtctctattccagggccgcggcggcctggacttgcgcgtgcgcggagaacccctgcaggtggagcgcacgctcatctattacctggacgagattcccccgaagttctccatgaagcgcctcaccgccggcctcatcgccgtcatcgtggtggtcgtggtggccctcgtcgccggcatggccgtcctggtgatcaccaaccggagaaagtcggggaagtacaagaaggtggagatcaaggaactgggggagttgagaaaggaaccgagcttgtaggtacccggcggggcaggggatggggtggggtaccggatttcggtatcgtcccagacccaagtgagtcacgcttcctgattcctcggcgcaaaggagacgtttatcctttcaaattcctgccttccccctcccttttgcgcacacaccaggtttaatagatcctggcctcagggtctcctttctttctcacttctgtcttgaaggaagcatttctaaaatgtatcccctttcggtccaacaacaggaaacctgactggggcagtgaaggaagggatggcacagcgttatgtgtaaaaaacaagtatctgtatgacaacccgggatcgtttgcaagtaactgaatccattgcgacattgtgaaggcttaaatgagtttagatgggaaatagcgttgttatcgccttgggtttaaattatttgatgagttccacttgtatcatggcctacccgaggagaagaggagtttgttaactgggcctatgtagtagcctcatttaccatcgtttgtattactgaccacatatgcttgtcactgggaaagaagcctgtttcagctgcctgaacgcagtttggatgtctttgaggacagacattgcccggaaactcagtctatttattcttcagcttgcccttactgccactgatattggtaatgttcttttttgtaaaatgtttgtacatatgttgtctttgataatgttgctgtaattttttaaaataaaacacgaatttaataaaatatgggaaaggcacaaaccagaagtcggcatttgtgaaaagtccctccagatttctatcacattggtctctaatttcccaagacttgtattttttttttatttcaaattataacacttttttttcccccagaagtgggtgtttcatgttgctactctggtgtgtcctaagatatcctaactggccagtgtaaatgctattctttctaaataagattatttggaaacttccttcaaactgcaggagggtgagcttgagggaggaagctaaaactagctgcttttatgaaaaagagtgccagtctttggtcatctctaaacaaggcttatcaccaatggagacagaaaactctagttcaagagctgtacctcctttgaatcccagccctactttgaaataagtggtactatttccatttagcctttgagcaaatcacttaatctcaaagcgttgtggctctaagattaaacgacttt

SEQ ID NO: 405 - DNA, 2338 bp, Homo sapiens
aggaaaatcagatgttttagttctcttacagaccagcagtaatgttgaaaaatataaaagtagccgtaacagaaaacgaagtgatcatctcagccctcccttggagtggggggatatattgcggagctgagttttaatggctatcagttcttgatcagaaaagtgaaatcactccaactccttccgtattccacggaatatgacccgtcttgaactttgagaaattccccgggtctgtgtgaaattccagttccaaataattcacatgaatggttcacaagaatccaggtaggtttgatctaagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaata

SEQ ID NO: 406 - DNA, 2036 bp, Homo sapiens
agtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagccctgttggcagctctagctttgcagtcgtgtaattggcccaagtcattgtttttctcgcctcactttccaccaagtgtctagagtcatgtgagcctcgtgtcatctccggggtggccacaggctagatccccggtggttttgtgctcaaaataaaaagcctcagtgacccatgagaata

SEQ ID NO: 407 - DNA, 2243 bp, Homo sapiens
aggaaaatcagatgttttagttctcttacagaccagcagtaatgttgaaaaatataaaagtagccgtaacagaaaacgaagtgatcatctcagccctcccttggagtggggggatatattgcggagctgagttttaatggctatcagttcttgatcagaaaagtgaaatcactccaactccttccgtattccacggaatatgacccgtcttgaactttgagaaattccccgggtctgtgtgaaattccagttccaaataattcacatgaatggttcacaagaatccaggtaggtttgatctaagtttcgcccgcaccactacagggccgctggggagtcggggccccccagatctgcccgcctcaagtccgcgggacgtcacccccctttccacgctactgcagccgtcgcagtcccacccctttccgggaggtgagggaatgagtgacggctctcccgacgaatggcgaggcggagctgagggggcgtgccccggaggcgggaagtgggtggggctcgccttagctaggcaggaagtcggcgcgggcggcgcggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaagggggtccccctgtaccgccacatcgctgacttggctggcaactctgaagtcatcctgccagtcccggcgttcaatgtcatcaatggcggttctcatgctggcaacaagctggccatgcaggagttcatgatcctcccagtcggtgcagcaaacttcagggaagccatgcgcattggagcagaggtttaccacaacctgaagaatgtcatcaaggagaaatatgggaaagatgccaccaatgtgggggatgaaggcgggtttgctcccaacatcctggagaataaagaaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccagtggtgtctatcgaagatccctttgaccaggatgactggggagcttggcagaagttcacagccagtgcaggaatccaggtagtgggggatgatctcacagtgaccaacccaaagaggatcgccaaggccgtgaacgagaagtcctgcaactgcctcctgctcaaagtcaaccagattggctccgtgaccgagtctcttcaggcgtgcaagctggcccaggccaatggttggggcgtcatggtgtctcatcgttcgggggagactgaagataccttcatcgctgacctggttgtggggctgtgcactgggcagatcaagactggtgccccttgccgatctgagcgcttggccaagtacaaccagctcctcagaattgaagaggagctgggcagcaaggctaagtttgccggcaggaacttcagaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgtggagttcgtaccgcttccttagaacttctacagaagccaagctccctggagcccggcccaagtcattgtttttctcgcctcactttccaccaagtgtctagagtcatgtgagcctcgtgtcatctccggggtggcc

SEQ ID NO: 408 - DNA, 3494 bp, Homo sapiens
cgaggacaggtgtggttttgtccctgtggaacagatggggaaactgaagctccagagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgattcggctgtctcagactctttttgtacctggtgaccccttttcagcttctgctgggctggggcctgatggggagggtctcggtggtaccaggtctcctccaccgccatggcttccaaggtggtctgctcgggcccaggccatcttccaggtggggtgaggcagtgggtcccacttcccctcctacccctcccagctgacagtcctctccacctagtggctgtccagtgcccattcctcaccttttcccggggaggagagagcagcttctgccacttcccaggtaagcaggaggaggtgccaacagtgttaggcctggcacagtgtctgggctgactgggaccgtctcaggcccacagaacacccctgcacagca

SEQ ID NO: 409 - DNA, 3466 bp, Homo sapiens
cgaggacaggtgtggttttgtccctgtggaacagatggggaaactgaagctccagagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctgtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgattcggctgtctcagactctttttgtacctggtgaccccttttcagcttctgctgggctggggcctgatggggagggtctcggtggtaccaggtctcctccaccgccatggcttccaaggtggtctgctcgggcccaggccatcttccaggtggggtgaggcagtgggtcccacttcccctcctacccctcccagctgacagtcctctccacctagtggctgtccagtgcccattcctcaccttttcccggggaggagagagcagcttctgccacttcccaggtaagcaggaggaggtgccaacagtgttaggcctggcacagtgtctgggctgactgggaccgtctcaggcccacagaacacccctgcacagca

SEQ ID NO: 410 - DNA, 3437 bp, Homo sapiens
catccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgccttttataaacctctaatttattttgtcgaatttttattatttgttttcccgccaagcggaaaaggttttattttgtaattattgtgatttcccgtggccccagcctggcccagctcccccgggaggggcccgcttgcctcggctcctgctgcaccaacccagccgctgcccggcgccctctgtcctgacttcaggggctgcccgctcccagtgtcttcctgtgggggaagagcacagccctcccgccccttccccgagggatgatgccacaccaagctgtgccaccctgggctctgtgggctgcactctgtgcccatgggcactgctgggtggcccatcccccctcaccaggggcaggcacagcacagggatccgacttgaattttcccactgcaccccctcctgctgcagaggggcaggccctgcactgtcctgctccacagtgttggcgagaggaggggcccgttgtctccctggccctcaaggcctcccacagtgactcgggctcctgtgcccttattcaggaaaagcctctgtgtcactggctgcctccactcccacttccctgacactgcggggcttggctgagagagtggcattggcagcaggtgctgctaccctccctgctgtcccctcttgccccaacccccagcacccgggctcagggaccacagcaaggcacctgcaggttgggccatactggcctcgcctggcctgaggtctcgctgatgctgggctgggtgcgaccccatctgcccaggacggggccggccaggtgggcgggcagcacagcaaggaggctggctggggcctatcagtgtgccccccatcctggcccatcagtgtacccccgcccaggctggccagccccacagcccacgtcctgtcagtgccgccgcctcgcccaccgcatgccccctcgtgccagtcgcgctgcctgtgtggtgtcgcgccttctcccccccggggctgggttggcgcaccctcccctcccgtctactcattccccggggcgtttctttgccgatttttgaatgtgattttaaagagtgaaaaatgagactatgcgtttttataaaaaatggtgcctgattcggctgtctcagactctttttgtacctggtgaccccttttcagcttctgctgggctggggcctgatggggagggtctcggtggtaccaggtctcctccaccgccatggcttccaaggtggtctgctcgggcccaggccatcttccaggtggggtgaggcagtgggtcccacttcccctcctacccctcccagctgacagtcctctccacctagtggctgtccagtgcccattcctcaccttttcccggggaggagagagcagcttctgccacttcccaggtaagcaggaggaggtgccaacagtgttaggcctggcacagtgtctgggctgactgggaccgtctcaggcccacagaacacccctgcacagca

SEQ ID NO: 411 - DNA, 441 bp, Homo sapiens
atgcccgatgctgccttaagccttatgaggtcaccacggaactgcagggaatctttgccggtgctactgtttttatgcttgcttctgaagacgtgtgaacctaaaactgcaaatgcctttaaaccaaatatcctactgatcatggcggatgatctaggcattggggatctcggttgctatgggaacaatacactgagaatgccaaatattgaccagcttgcagaggaaggtgtgaggctcactcagcacctggcggccaccctgctctgcaccccaagccgagctgcattcctcatggggagacattctttcaggtcaggcatggacgccagcaatggatactgggcccttcagtggaatgcaggctcaggtggctccctgagaacgaaaccacttttgcaagaatcttgcagcaccgcgactatgcaactggcctcataa

SEQ ID NO: 412 - DNA, 1472 bp, Homo sapiens
aaggtcaccccatctctgatcttcgccatcacaattgctacaatcggctctttccaatttggctacaacactggggtcatcaatgctcctgagatgatcataagggaatttatcaacactttgaaggacaaggcaaatacccctccctctgagatgttgtgcttgtccctttggtgcttgtctatggccatattctccattggttgtatgattagctccttttctgttggactgtttgtcaacagctttgacaggcgtaattcaatgcttactgtcaacctgttggctgccactggtggctgccttatgggactgtgtaaagtagctgagttggttgaaatactgatcctggcctacttggttattggcctcttctgcagactctgcacaggttttgtgcccacgtacatcggagacatctcacctattggcctgcaaggtgtctttggcactctcaaccagctgggcattgttgttggaattctggtggcccagatctttgatctggaattcatcctggggtctgaagacctatggcctgtgctattaggctttcccatctctcctgctatgctacaaagtgcagcccttcctttttgccctgaaagtcccagattcttgctcattaacagaaaagaagaggagaatgctaaggagatcctccagtggttgtggggcacccaggatgtatcccaagacatccaggagatgaaagatgagagtgcaaggatggcacaagaaaagcaagtcactgtgctggagctctttagagtatccagctaccgacagcccatcatcatttccatcatgctccagctctctcagcagctctctgtaatcaatactgtgttctattactcaacaggaatctttaagggtgcaggtgttcaagagcccatctgtgtcaccattggtgtgggtgtggttaatactatcttcactatagtttccctatttctagtggaaagggcagtaagaaggactctacatatgataggccttggagggatggctttttgttccatcctcatgtctgtttgtttgttattgaaggatgagtgtaatgggataagctttgtctgtattggggctatcttggtctttgtggtcttctttgaaattgggccagaccacattccctggtttattgtggctgaactcttcagccagggccctggcccagctgtgatggcagtggccggctgctccacctggacctccaacttcctagtcagattgcttttcccttctgctgcttactatttaggagcctacgtttttattatcttcaccgacttcctcattaccttcttgatctttaccttcttcaaagtccctgagatgtgttacaggactttcaaggatatcacataggcctttgaggggcaggcacacgatgcaaatagatctggaaggactgtgtcatggagatgaacagtatccagcctgctaaggagaccaccaccaatgtc

SEQ ID NO: 413 - DNA, 2742 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctgtgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggaatgcaatggcacgatctctgctcactgcaacctccgcctcccgggttcaagcgattttcctgcctcagcctcctgagtacccaggattacaggcaccaggcacctgccaccatgcctagctaatttttgtagttttagtagagacagggtttcaccatgttgcccaggctggtctcgcactcctgacctcaagtcatccacctgcctcagcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggag

SEQ ID NO: 414 - DNA, 5028 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctgtgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggtaggtgccgcggtgtcggagcatcggcagaccctgagtcctgtgccccagcagttttccatgagcaacatcctgtggaagccgtggctgcagccgtgctgcggacatttcccgttctgttcatgccacgaggatggggatggcaccccctgaatgccaggactgtgagagaggatccaggagagcctgactgcgttgcaaacaaaattctccaagcttggttctatcttcagcttccctttttgcaaggaacatgccctggactgagagtgggtccccactttctttctttctttctttcttttttgagacagagtgtcgctctgtccctcaggctggaatgcaatggcacgatctctgctcactgcaacctccgcctcccgggttcaagcgattttcctgcctcagcctcctgagtacccaggattacaggcaccaggcacctgccaccatgcctagctaatttttgtagttttagtagagacagggtttcaccatgttgcccaggctggtctcgcactcctgacctcaagtcatccacctgcctcagcctcccaaagtgctgggattacaggcacgagccactgcgcccatgtagggtttccctttcctgatttgtgaaataagactgtcccagtaggcacccactgatgcctcctcttcctcttctaaatctcagggttcgtcattgtgccaatgcccgatgttttcacccctccgtcttaaagcattgttgcaatttcatcacctagatgacataacagccttacaaaaggacagggaggagtgtctgttcctactctcacatagcggaggaaagttagagcctctcagtctctgtttatgaggactcattaatctcaaataattgatgcatttttcatacattagggtctctgtccatgtgtcttcctgatattgttatagaaatggcttcaggctgctggtaacagatgctgcggaaaaagaatgccttaaacaaagccaggcacggtgactcacacctgtaatcccagcactttgggaggctgaggcgggaggattatttgagcctgggaggtcaaaactgcaatgagctaagattgcactactgcactccgggctgggagacagagtaagaccctgccttaaaaaaaaaaaaaaaaaaatgccttaaagaaaataataagagaagggtgtgttctcttccaagtaatgagccgatcaaggggaagcaacccaaggctagcaggctcttttcaattcccagctctgccactcttagcatggcagagagttggcctcattatgccagtatggctgccacagtgtcagacatcacattccaggcagtggaaaggagaaagaaccaaagggcatccctttctcttgaagcagtccctgtgaggggggattatctggaagccccaacccaatttctgcttccaaccattatccatagaaacaactggaagttgagaagtgcagtcttttaggtgggcacctggctgccctgtatgaaaccagaattaggttggtcagcaggaaaacaagaaaacacttactgtgttgactgaggtttttgacgcatcgctttattgtcaaattaaacaactctatctcattctgcactgaaacacgtactaccattgcctataattggaaaatgatcctcagaggcacagaagatgccctgatggaaagtttgccccttgggcaaagagacagccatgggaaccttcagacatagagagagaaggtggcttttctccctacattcctcaaatagctaagatttggccagtgtgttttctaagtcaattctagtgtgtttcatcctcacctcttccctctgtggctttgatgatggaagtgtagtcctaacctactgcacagctgggaccccctgcccctagatcccaatactggggatgggaggaccttgcactattcccctcagtccatctatcgaggtctttgcaggaagcatactgggaattgaaacgagagcctaaatgacatctaagaaaggcagtgttcaataccaggtattaggtgaggatgggattctaaggacatcagtgggaggcagggagccaccttcagacctcagcatggaagcttccaagatccagaggaagaggcaacagcactgagagtcataggtagaagaatcatcacagccctgctaaccaggcagctgatgcccctctcccctggctccctgtgtccaaatcctacaggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctccctg

SEQ ID NO: 415 - DNA, 2806 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctgtgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcataggtaaggttcttaatgccatcgaagacaatggtttaaagaactcaacattcacgtatttcacctctgaccatggaggacatttagaggcaagagatggacacagccagttagggggatggaacggaatttacaaaggtgggaagggcatgggaggatgggaaggtgggatccgcgtgcccgggatcttccactggccgggggtgctcccggccggccgagtgattggagagcccacgagcctgatggacgtgttccctactgtggtccagctggtgggtggcgaggtgccccaggacagggtgattgatggccacagcctggtacccttgctgcagggagctgaggcacgctcggcacatgagttcctgtttcattactgtgggcagcatcttcacgcagcacgctggcaccagaaggacagtggaagcgtctggaaggttcattacacgaccccgcagttccaccccgagggagcgggggcctgctacggccgaggcgtctgcccatgctccggggagggcgtgacccatcacagaccccctttgctctttgacctctccagggacccctccgaggcacggcccctgacccccgactccgagcccctgtaccacgccgtgatagcaagggggcatctgttggctgaactcaacctgaagccaaagagaagatgagtggagagaggcaacatttatagagctcaggtttctagggctggagagggatctggagggacacacaggagacacctggcataaccaaaaaatgattaaaaaaaaaaaaaaaaagaaacatctatggagcatgggacacggggagtggaggcagctaaaagccatctcatctttcaccgtattcaacaagcccattataacaagtctttcacgctcaaccattcaaacaatcccaacaatcccagcctaagaatttcctggcatttgatgaaaatggctgtgggttttgctatctttaagctccctgggaagcaggatataagcccagggctggcaggctctttctagctacctgctcttgcacatagagtttgcctcatggttgcaagaaggctgccatagctccagatggcacatagacattccaggcagcaggaaaaaggaaggagcacttaaccgaaggaggtcagggagttggttagtctccacctgaagaagagagccatgaaccagcttcagttgactaacgggctcctgtgagtgcatctttggacttttctggaggttgaaatctagatgtggtatgtgtcttaaagcagccaccaactcctcccattaccttccaagtgagcccaactacacgatggagcctcttccctgcccttggatctgggctgagcctctgacttgcgttgaccaacagaatgcagtgaaagtgatgccgatactaccctccctgccctagacttgggatacctggcagctatattcttccattcctcaggacttgcaaaaacgggtctcagcatgccttcccagagccatgaggtgtttctttgcccattcattgatctgagaagtgagtgtaaggagtttaaatcaacctctgttctgtgctagttaaggtaataaagttgctgcagtccagggggtaggtacctgtggacggctctgcgaataggacagttgcatttcttgggaatcaagtgcatccctaggctggcagtgcagcagaaatactgaataaaatgtgacaaatctccctg

SEQ ID NO: 416 - DNA, 742 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggtgtggatatgtgggagcctcacattatacggtggttgggaatattcgtgataaaaaagatcccaggccaggcgtggtggcgcacgcctgtagtcccagctacttaggaggctgaggcaggagaatcgcttgaacccgggaagcggaggttgcagggagccgagatcacaccactgcactccagtctaggtgacaaagcgagactctgtctcaaaga

SEQ ID NO: 417 - DNA, 2245 bp, Homo sapiens
ctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctaggcactggggatctcggttgctacgggaacaatacactgagaacgccgaatattgaccagcttgcagaggaaggtgtgaggctcactcagcacctggcggccgccccgctctgcaccccaagccgagctgcattcctcacagggagacattccttcagatcaggcatggacgccagcaatggataccgggcccttcagtggaacgcaggctcaggtggactccctgagaacgaaaccacttttgcaagaatcttgcagcagcatggctatgcaaccggcctcataggaaaatggcaccagggtgtgaattgtgcatcccgcggggatcactgccaccaccccctgaaccacggatttgactatttctacggcatgcccttcacgctcacaaacgactgtgacccaggcaggccccccgaagtggacgccgccctgagggcgcagctctggggttacacccagttcctggcgctggggattctcaccctggctgccggccagacctgcggtttcttctgtgtctccgcgagagcagtcaccggcatggccggcgtgggctgcctgtttttcatctcttggtactcctccttcgggtttgtgcgacgctggaactgtatcctgatgagaaaccatgacgtcacggagcaacccatggttctggagaaaacagcgagtcttatgctaaaggaagctgtttcctatattgaaagacacaagcatgggccatttctcctcttcctttctttgctgcatgtgcacattccccttgtgaccacgagtgcattcctggggaaaagtcagcatggcttatatggtgataatgtggaggagatggactggctcatagccagtgacttcatgtcatcatcagaagttaccgaaagtgaagcgataaagttaatgttcaggacaatgcagagacgctgtcttccttctatggccttcaagaaaccctggagaggaccagtgaggctgcagattcttaaaagagcatagacattaaaattcttgcagaatctgaatgtgtctcctgagacaagcatcgtgatagagttcacagtcttaaaagtctgcattttcaggtggggcaaggtggctcatgcctttaatcccagcattttgggaggctaaggcagggagatggcttgagaccaggagttcaagaccagcctgggcaacatagtgagacgcccccccccccatctctacaaaaaatttaaaaaattagccatggtggtgtgcacctgtggtcccagctactccagaggctgaggtgggaagatcatttgagcccaggaggctgaggctgcaatgagctataattattgcaccactgaactccagcctgggccacatagcaagaccctgtctccaaaaaaaaaaagaaataaaagacgaagaatagggagaaaaacttctctcatatcatttatttggtccttcagtatttctgattacttagtctaattttgcacaaaatcaactgtattagtccattcttgcaaagaaatacctgagactgggtaatttataaagaaaagaggttggattggctcacggttctgcaggctgcacaggaagcatggcagcatctgcttctggggagacctcggggagcttttgctcatggtggaaggcgaagggggagcaggcgtcttgtggcaggagaaggaccaagagaggagaggaagagccgcacacttttaaacaaccagatctcgtgagaagctactccctccgcagcaccaagcgggggatggtgctcaaccattcatgagaactctgtccccatcattcagtcacctccccccaggccccaccgccgattctgaggatgacaattccacatgagatttgggcggggacacacatccaaactatattgtcaaccttctacacagccaatgacttaacagcctcattagaagttacagaaactaaagcaataaagttcggacaatgcagagaggtcaccttccttctatggccttgaagaaaccctggag

SEQ ID NO: 418 - DNA, 213 bp, Homo sapiens
ttcattattaattataccaatcctttcatatatgtagaaaaaatgtttgagttggtcatctgtcttttattgaagatgcatttcaaatatcaaatatatttgaaagataaaatagcatctgtgaaattgaatattattttatgtgcgcttggctatgccctaaaatgtcagtttattatccctaaagacgtatttattgatgtttaccaagaa

SEQ ID NO: 419 - DNA, 2010 bp, Homo sapiens
atggagaggcgagcacgtccactcagactcggggtcctgccttcagtgcccccattcccatgccctcatccactcgatgcttcgacctgtcctcccaatgctgagcaaccagaggaggcccacagccagcaaaaagcctttcctctcaggtccatgggcaacagaggaagtgatgcctggagcttctcctgggctgagccctcatctggctgtgtccaggatgaagagcagtggttcaggcccactggggagcacgtgctggtggtgtgcctgctgctgaagcacctgcaggcatttgccaacagcctgaagcctgagcaggcctcgctctcctcccactcccactccaccagccgcctggaggagttgaaatgggccactgtcccaagattcgtccagcagaaactctacctcttcctgcagcgttactttggccactgcccactggccgcatcgttcagagctgtactggctccgcaggttcctacccttaccagaccagggagcactgggccccctgggctgggaaaagcccacccatggccctggcttctgaagggcctgcaagagagccaaacctcacagggctgtgtcctggaaatgtggctgagctacctgcagccatggcggtatgtgcctgacaagcaggctccaggcagcgactcccagtcccggtgtgcattggagaaatgccatgccactggctccccaaaatggatgttgctccagtggttggaggccaagccagtggcctgtgctggagtcagcctggccctggccccggtggcctcctgggttcctctcccaggccctgctttgtggagcacagaccagcccttcctaggctcaactttgccaggccctagaattgaccagtgtgtggagagccccctggctgctccttcctgttgtggctgggctttggcccccatgaataccaacggctcctactcagccaacgacctggacaagatggggcgggacagtgtccagaagacagacaagtacctggaggcggccctggagtacctgcaccagatattcccggtacaaactatggggcctgccccacagccatcagcgtccccttcttcaaaggatccactccccctcactcagcctgtggtcagcccaaagggcagaggcgcttctttctggcaactcagtgaagcacagctcacacaattcacacttgccttgggcaccacccaggatgagaatgaaaagcagcagctcctcgactgcaccgtgggtgaggatggactcatcctcatgccgctgggtcagtaccaggtgagaggcccctgtcccagaggggacccagagctgcagtccatctggagctacgagattgccagcttgatctgtgtgctcttccagtggtcgtctgccatcaaccacagacaggcacctgctaagcctcatgggcagatgcaggcagccggccatgcccatggccccaggctcagcctgtgcctcctgggtagctaccagattccgctttggctgctgctggccttctttgagcctgcttctgagccccacgcctgtggcagcacgtgccaccctgcctgcactgaagcggaccctgaagaacaactttgccaagcagcagaagaggctgcaggcactgcagaactggcacctgcccctctcccctctcggtgctttgagccacctgcatctgtgtccgcagccgggagcaggaagtttgccaggaagctggagaaggaaccaggccaaggaatgggacattatgtcagaaaaggagagctgaggtcagggctgaccagggccagactgcacagtgctggccccaagactgatagcatcctgacaggacggcaggcccaggttcatggagaagggtacacagtgacaactcctgatgaacacaggaataatgaatttatgataacaatcacaaatgatggggtagtgcacataaaaagggcgggacctcttatcaccagagggctgcaggccattgcccaagagtggcaggcagca

SEQ ID NO: 420 - DNA, 901 bp, Homo sapiens
ggcatgatatgggctgaatgtaaagaaatttggactcaaggccccaaggaatatttgtttgagttgtggaacatgcttgattttggtatgttagcaattttatcagcatcattcattgcaagattcagggcattctggcatgcttccaaagcccagagcatcactgatgcaagtgatactttgaaggacttgacaaaagtaacattgggagataatgtgaaatactacagtttggccaggagggagtgggacccctcggatcctcgtatggtgtctgaaggtctttgtgcagttgctgtggttttgagtttctctgggatagcttgtattttgccagcaaatgaaagctttggacctctgcagatgtcgcttggaggagcagtcaaagacatcttcaggttcatgctcatattcattatggtgtttgtggcctttatgattggaatgttcaacctctactcctactacattgatgtaaaacaaaatgaagccttcacaacagttgaagagagttttaagacactgttctgggctacatttgtgctttctgcagtgaaatcagtggtcatcaactatagccacaaattcattgaaaacattggttatgttctttatggagtctatgatgttacaatggtcattgttttgctaaatatgttaattgcaatgatcaacagttcactccaggaaattgaggatgacgctgatgtggagtggaaatttgcaagggccaaactctggttttcctgctttggggaggggagagcacttcctgttcccttcaatctggtgccgggtccagggtccctgttttgtctcctgctgaagcttaaagggtggatttctgagctctacccagggtcataaaaaaggtttccaggaagaggtagagctaagtaag

SEQ ID NO: 421 - DNA, 986 bp, Homo sapiens
aaaagtatctcaaaggctgttgagcacctcaataaagctattccgcccgtcttggtgagcaagaagctgtgtgtgtgaaattgggggacagtaacaaactggaagaaggcatgaatttaaatctaactgggaacacatctaaattgggtgcaaagaccttactagaagtgctgcttgctgtctgtgatgttgaagctgctgcaaggagccacctatactgtcacaatgggtcctggctggcaatccaaaagtatctagccaatgccagctttcagcaaggtccatggtagttttcacagtggtaatgggccggcagtgcaggagttcatggttctccctgctagaaccgtaacctcaggaaagccgtgctttaccagaaggatgtcatcaggcagaaatatggcaaagattcctcctaaacactggagctgctatggaatgtgattagaaagcctggctgtattataagtagtgaatggcatggacaatagcctctagttcttacagttcaggaaatatgaccttgatgttcaagcctccagatgtccttagcagttacatcacttctgaccagctggtaggcaggtacaagtccttcatcaaggactactcggtggtgtctactgaagatgccttggaccaggatgaccgagaaacttggcagaagctctctgctagtgcaggttatatccatgtgacagggaatcatctccctgtgcccagccggaaaggaactaccaagactacagacaaggactcgggcaactgcctcctactcaaggtgaatcagacagaccccatgatggaatctcttcaggagtgcaaagtggcccaggccgaaggatagggcgctatttcccactgtgttggggtgactgaagattcttgcattgccaaactcatggtgaggatctgtactaggtcaaccaaggctgcggccccttgcccatctaagcacttggccaagtacagccacctcctcaggt

SEQ ID NO: 422 - DNA, 6827 bp, Homo sapiens
cgaacggccggttccggctgaatgtcagtgctgggctgtgggccggggaggaaggcggctcgcggttcctccaccgcctccgccgccgcatcctccgcttgtgctaccgccgcgggcgctgggccgctctgctggtccggcatgagaccgtgagacgagagacgggtcggggccgccgacatgtttggccgctcgcggagctgggtgggcgggggccatggcaagacttcccgcaacatccactccttggaccacctcaagtatctgtaccacgttttgaccaaaaacaccacagtcacagaacagaaccggaacctgctagtggagaccatccgttccatcactgagatcctgatctggggagatcaaaatgacagctctgtatttgacttcttcctggagaagaatatgtttgttttcttcttgaacatcttgcggcaaaagtcgggccgttacgtgtgcgttcagctgctgcagaccttgaacatcctctttgagaacatcagtcacgagacctcactttattatttgctctcaaataactacgtaaattctatcatcgttcataaatttgacttttctgatgaggagattatggcctattatatatcgttcctgaaaacactttcgttaaaactcaacaaccacactgtccatttcttttataatgagcacaccaatgactttgccctgtacacagaagccatcaagtttttcaaccaccctgaaagcatggttagaattgctgtaagaaccataactttgaatgtctataaagtggataaccaggccatgctgcactacatccgagataaaactgctgttccttacttctccaatttggtctggttcattgggagccatgtgatcgaactcgatgactgcgtgcagactgatgaggagcatcggaatcggggtaaactgagtgatctggtggcagagcacctagaccacctgcactatctcaatgacatcctgatcatcaactgtgagttcctcaacgatgtgctcactgaccacctgctcaacaggctcttcctgcccctctacgtgtactcactggagaaccaggacaagggaggagaacggccgaaaattagcctgccggtgtctctttatcttctgtcacaggtcttcttaattatacatcatgcaccgctggtgaactcgttagctgaagtcattctgaatggtgatctgtctgagatgtacgctaagactgaacaggatattcagagaagttctgccaagcccagcattcggtgcttcattaaacccaccgagacactcgagcggtcccttgagatgaacaagcacaagggcaagaggcgggtgcaaaagagacccaactacaaaaacgttggggaagaagaagatgaggagaaagggcccaccgaggatgcccaagaagacgccgagaaggctaaaggtacagagggtggttcaaaaggcatcaagacgagtggggagagtgaagagatcgagatggtgatcatggagcgtagcaagctctcagagctggccgccagcacctccgtgcaggagcagaacaccacggacgaggagaaaagcgccgccgccacctgctctgagagcacgcaatggagcagacccttcctggatatggtgtaccacgcgctggacagcccggatgatgattaccatgccctgttcgtgctctgcctcctctatgccatgtctcataataaaggcatggatcctgaaaaattagagcgaatccagctccccgtgccaaatgcggccgagaagaccacctacaaccacccgctagctgaaagactcatcaggatcatgaacaacgctgcccagccagatgggaagatccggctggcgacgctggagctgagctgcctgcttctgaagcagcaagtcctgatgagtgctggctgcatcatgaaggacgtgcacctggcctgcctggagggtgcgagagaagaaagtgttcaccttgtacgacatttttataagggagaagacatttttttggacatgtttgaagatgagtataggagcatgacaatgaagcccatgaacgtggaatatctcatgatggacgcctccatcctgctgcccccaacaggcacgccactgacgggcattgacttcgtgaagcggctgccgtgtggcgatgtggagaagacccggcgggccatccgggtgttcttcatgctgcgttccctgtcactgcaattgcgaggggagcctgagacacagttgccgctgactcgggaggaggacctgatcaagactgatgatgtcctggatctgaataacagcgacttgattgcatgtacagtgatcaccaaggatggcggcatggtccagcgattcctggctgtggatatttaccagatgagtttggtggagcctgatgtgtccaggcttggctggggagtggtcaagtttgcaggcctattgcaggacatgcaggtgactggcgtggaggacgacagccgtgccctgaacatcaccatccacaagcctgcgtccagcccccattccaagcccttccccatcctccaggccaccttcatcttctcagaccacatccgctgcatcatcgccaagcagcgcctggccaaaggccgcatccaggcaaggcgcatgaagatgcagagaatagctgccctcctggacctcccaatccagcccaccactgaagtcctggggtttggactcggctcctccacctccactcagcacctgcctttccgcttctacgaccaggggcgccggggcagcagcgaccccacagtgcagcgctccgtgtttgcatcggtggacaaggtgccaggcttcgccgtggcccagtgcataaaccagcacagctccccgtccctgtcctcacagtcgccaccctccgccagcgggagccccagcggcagcgggagcaccagccactgcgactctggaggcaccagctcgtcctccaccccctccacagcccagagtccagcagatgcccccatgagtccagaactgcctaagcctcaccttcctgaccagttggtaatcgtcaacgaaacggaagcagactctaagcccagcaagaacgtggccaggagcgcagccgtggagacagccagcctgtcccccagcctcgtccctgcccggcagcccaccatttccctgctctgcgaggacacggctgacacgctgagcgtcgaatcgctgacccttgtccccccagttgacccccacagcctccgcagcctcaccggcatgcccccgctgtccacgccggctgccgcctgcacagagcccgtgggcgaagaggctgcatgtgctgagcctgtgggcaccgctgaggactgagtcagtgccggggcctccctttgtgtgtgtggccccgctggtagggaccccagtgccgctgactggcaagacacactgggagcacccaccattctgtgcggcccccagcagccatctcaaccacctatccctgcgctcccttgaatgggaagaagccccacgttgtccttgaattcctttttcactttgcatctcttcacgtgcaggctgggaccagcggagacaccgcggcgaatgcagatgactgcaccggccactcagggagctgcctgggctccgtgtctctgagccccgggtggcaggacccaccggcacctctttcttcctctgtcatatggctcctctgtcaccagccccagtgtgcacagaagaattggaccaggtcactgtacgtagaaatttgtagaaaagcagacttagataaacatctcctttggatatttatttccgcttttggcagcaggtgaacatttatttttaaaacttctatttaaaagaagtccaaaaacatcaacactaaggtttgatgtcatgtgaaaagtgtaataataacagttaagatttcatgatcattttcactggacctttcctgatattttgtttcagagttcttagtgtggctttttccatttatttaagtgattctttgttactcactaactctgcaagcctgtggaataatgaagtaccttcctggaaagtttggattattttttaaacaaaaacaagggagatacatgtattctcaggtacacacagagctgagagggctgaatggttttctgctatagcagccgagaggcctcccatcatggaaagatttctccaggaaaaggaggaatgtagccagctccccactcaggacgcttcctcatttctcttcaccaaaaccaaacagagacagcttccagcaccttcttcagtgttaccatctctaagaaggaaccagttgggaccgtgaagactcccgaccctgtggccatgatggaaatcaaaggaagacaccctctacgtcacctgccctcgactgtgtgtgcccacatgtgccgagagatggcccagagccagttcccctccagctgcaagggcatggtgtccccagagctctgagtctgtcactctccctctgctactgctgctgatctgaatatggaaaccccatggttcccttccccattcggactgggtgtgtacaagcaaggacccagatgcatcagacacagcccccaagatgttcctttctactcggccagctcgggagccagacacagcactcacagcccaggccgtgatccaccctccccaagtccaccagggccagcggcccctcacctctctggtcactggtgagaccttccacaactttcctccagacctgccagcagatgtgcccaccaggggcattaggtatccgccggagcctggccatagggtagtctcgggagccgcgctgagatcttttgccacctgcattttagaagaacatggtctctgtctcctcggcccagccagctgtcccggcaaggcctgccgagggcagttttcaacctcatgaaggaaacacagtcctgccaaggagggggagtggcgcccatggggacaggcctcagtccttagaagccctctgggtagctgtgcccacccagccttcatggctgcaggtacaaggacctttgcttccatagagaaaacgcacagctcagaaagggggccacatgggcagaaacccaaaggaaggacaaaccacgaccaccgtggccatctgcagaatccctggaagagaaggaaggcagggtggagcggggggaagaccatcatggagagaaggaccacagcatcaggagacgggacacgccacacccagcaggcagcctgtgtgttgcttaattttttaagagcaagaggggtagagaggatcaagctggccctggctggagatggctagcccctgagacatgcacttctggttttgaaatgactctgtctgtggggcagcagaaactagagaaggcaagtggctgccccaccccaaggcgtgaccaggaggaacagcctgcagctcactccatgccacacgggtgggccaccagcctgctgtcagaagtctctgggctccaactggtcttgtaaccactgagcactgaaggagagaggtcttggtcagggctggacagcatgcccgggaggaccagcagaggattaaaggtgactgggaggaccagcggaggataaaagacactgctcagggcagggcttctaccctgcatccctggccaagaaaagggcagtccccatgtgggcttgcagggtcactctcaggggcctctttcagctggggctggcaacttgcgtctgggggacacctccaggtgtgtggggtgaggatttcctataaccagggctcccagaagctttgcttatgtaaggaggtctgggagccagcccattggaggccaccagccattttggcttcaaaggaccccacctcacccaggtctcagcggcagtgggcacagctatgtcttcaggagctcccgtcaaacctcatagctggggcgctcccagacaggccagtccagacaggacacgctgggcccctggcatccagaggaagagccaggagtgtgggaaggcccacagtgggggctgtggcttctgacactcaggtcatagcctcagaggtctgaggtcagcccccacagacccatccggcccgccccccaagtccctgcagagagcacttagagttatggcccaggccctggtccacccttcccctgtgcacctccggctgggtttgccaagtcagggagcagggctggccgcaggaactcccaaaccttggctttgaatattgttgtggaggtgtgctcgtccctttctggacgtgcaaggtacctgtcccagcaggtcagatggggccagctgaggcgctcccccaggcaggaagggccagccttcaccatcgcgtgggattgggaggaggggcctccgtgagcagcccctcctctgccgctgtcccagcccagtccctctcccggagccttggcagcctcccacaacccagacacttgcgttcacaagcaacctaaggggcaggtgaagaagcgcagccctgccagacgcgctagattcctctaaggtctctgagatgcaccgttttttaaaaaggcgtggggtgaactgattttgatcttcttgtctagatgcaataaataaatctgaagcatttaatgtagtcatcttgacattgggcctacactgtacgagttccttatgtttccttgagctaaaaatatgtaaataatttttgtcccagtgagaaccgagggttagaaaacctcgatgcctctgagcctcgggaccgctctagggaagtacctgctttcgccagcatgactcatgcttcgtgggtactgaacacgagggtggaaatgaaaactggaacttccttgtaaatttaaacttggcaataaaagagaaaaaaagtt

SEQ ID NO: 423 - DNA, 1032 bp, Homo sapiens
atgcgggatacagaggctctcctgtggttcacacagaaagatgggaaccacacgggaccagaaatacggaccagggtcaagaactggtacctcaggatggagaaggcaagaaccaagtggaaccacgagagggatccaagatcagttgggagagttggagaatgggcatggctggcctcatcctttctttattcttcaggctctaatttctcatcagctgagtccaacagggaagacctgcccctggctgcccgtgccttctctgatgaggatattgtctttgctctggccatgaccaagagtgtgatttcaggaaagtttcttaaccttcctgagcttctgttttctcttcagtttaataacaacaataacatgaggttactatgggtgaatgaacgctgctgcttcttggaactcaggcctttgagcataacttgcttggcatcctctgcatcaaaaaaatgttcagtattgtttcacttgcgccagaagagcttgtctggaaaacgtctgataagccatgattgcacccctgcacgactcaccagtcaaacaatgcagttattatgctcctgggagaagaaggataattacctccacggccaggtgccagtagcaagtttccctgtggccaattactgtgtggtgctctgtgtagctctcctgggtcatggttctcaactcctccagggagtgaagtttgaagctggagaagtggagaaggaacacagaatttgttctcaagtctctaagtctcaagtctctaaggaggaagcacttactgcacaatgtgggggaaggcatgacggcttgaaagaagcaaagacatcaggaagaactgcactgttccagtgcctttgggatgctatttttcaaaagaagctggttcctgccacccacccccgacattttgaaattcagcagaaccatcactgttggcaaacatttgctgctgactctctgaaaggctatgttgttatcttatcaacccggctgactcagagaaccatgcgtcaaggaggggcgagagtc

SEQ ID NO: 424 - DNA, 4015 bp, Homo sapiens
aagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcaccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggtgagactgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaa

SEQ ID NO: 425 - DNA, 4172 bp, Homo sapiens
gcgcgcgggcagctcacttccgcccggcaggtgacagccgcggggctccgagccgccggcagcccggacgcaccgggagagcgagaggtggaggccgcggacattttggtgccaagccgaaccgagccggggcgccgggagctattgggacctgcggaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcaccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacggtgagactgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaa

SEQ ID NO: 426 - DNA, 2958 bp, Homo sapiens
cgcctccccctccgcctccgcctgcggtgcacattaaagatccaaagtcatgactgactccaagtatttcacaaccaataaaaaagcagaaatatttgaactaaaagctgaactcagcaatgaaaagaaagaaaagagaaaggaggctgtgaagaaagtgattgctgttattaccgtggggaaggatgttagttctgtctttccagacatagtgaactgtatgcagactgacaatctgaaactaaagaagcttgtgtatctctacttgatgaactatgccaacagtcagccagacatggccatcatagctgtaaatagctttgtgaaggactgtgaagatcctaatcttttgattcgagccttggcagtcagaaccatggggtgcatctgggtagacaaaattacagaatatctctctgagcccctcctcaagtgcttagaggatgaggatccctatgttcggaaaacagcagcagtatgcgtggcaaaactccatgacatcaacgcccaaatggtggaagatcagggatttttggattctctatggggtctcatagcagattcaaatccaatggtggtggctaatgctgtagcagcattatctgaaatcagtgagtctcacccaaacagcaacttactcaatctgaacacacagtacattaataagctgcggacagccctgaataagtgcactgaaggggccagattttcatgctggactgcctgtctaattacaaccctaaaaatgatcggaaggctcagagcatctgtgagcgggtaactccccagctatcccatgccaactcagcagtggtgctttcagcggtaaaagtactaatgaagtttctagaattgttacctaaggattctgactactacaatatgctgctgaagaagttagcccctccacttgtcactttgatgtctggggagtcagaagtgcactatgtctccctgaggaacatcaacttaattgtccagaaaaggcctgaaatcttgaagcaggaaatcaaagtcttctttgtgaagtacaatgatcccatctatgttaaactagagaagttggacatcaggattcatttggcatcacaagccaacattgctcaggttctggcagaactgaaggaatatgccacagaggtgaatgttgactttgttcgaaaagctgtgtgggccactggacggtgtgccatcaaggtggagcaatctgcagagcactgtgtaagcacattgcttgatctaatcaagaccaaagtgaattatgtggtccaagaagtgattgttgtcatcagggacatcttccgcaaatactccaacaagtatgaaagtatcattgccactctatgtgagaacttagactcgctggatgagccagatgctcgatcggctatgatttggattgtgggagaataagctgaaagaattgacaatgcagatgagttactagaaagcttcctggagggttttcatgatgaaaacacccaggtgcagctcactctgcttactgccataatgaagctgtttctcaagaaaccaccaaaacacaagagctagtccagcagatgttgactttggcaacacaggattctgataatcctgaccttcgagaacggggctatacttattgggctcctctctcagctgaccctgtcatggctaaagaagtagtcttgtctgagaagccactgatctctcaggagacggaacctattgagccaactgcgttggaggagctaatctgccacattggttctttggcctctgtgtatcgtaagccttccagtgcttttgtggaaggaagtcatggaatccatcgtaaacacttgccaattcatcatgggagcactgacacaggtgacagccctgttggcaccaccaccgcaacgaacctggaacagcctcaggttatcccccgtcaaggtgatcttctggggagtcttttaaaccttgacctcagtctcccagtcaatgtgccacaggtgtcctccatgcagatgggagcagtggatctcctaggaggaggactagatagtctgtggtgtcatccccagcactcctctggccatccatacaccactgatgccaaaccagagcattgatgtctccctgcctctcaacaccttgggcccagtcatgaagatggaacctctgaataacctgcaggtggctgtgaaaaacagtatcgatgtcttctacttcagctgcctcagcccactcaatgtgctttttgtagaagacagcaaaatggagcaccaggtcgtccttgcaacatggaagaatattcccaatgaaaatgaacttcagtttcagattaaggaatgtcatttaaatgctgacactgtctccagcgagttgcaaaacaatgtttataccattgccaagaggaatgtggaagggcaggacattctgtaccaatccctgaagctcactaatggcatttggattttggccgagctacgtatgcagccaggaaaccccaattatacactgtcacggaagtgtagagctcctgaagtctctcaatacatctatcaggtccacaacagcattttgaaaaactaacaagactggtccagtaccctccaatcatgctgtgatcggtgcaagccaagaacccttaactggaagaaattgtattgctgtgtagagtctgaacccaaacacactgaggccacccagcaaggtagtaactagtctaacctgtgctaacattaaggcacaacctgttggatagttttagcttcctttgaacatttgtaaccactgcttcagtcacctcccacctctcaccacctgctgctgctatctgtccttatttgtgggcttctccatgctgtgccaatggctggctttttctacaccctcttttgagtatagtttggtagtttgtaattgagagctcatttcaaaagcagaaaaagacaaccaatattaaagcaagaaaaagtgtcattgaaa

SEQ ID NO: 427 - DNA, 4014 bp, Homo sapiens
tgcagaagcctggctacagataagggaccaaaatgactgactcaaaatatttcaccacgaccaagaaaggggagatcttcgagctgaaggcagagctcaacagtgacaagaaggagaagaagaaggaggcagtgaagaaagtgattgcatcgatgaccgtgggcaaagatgtcagtgccctcttccccgatgtggtcaactgcatgcagacggacaacctggagctgaagaagctagtatacctctacttgatgaattacgccaagagtcagcctgacatggccattatggccgtcaacacctttgtgaaggactgtgaggaccccaaccccctcatccgagccctggcagtgcggaccatgggctgcatccgcgttgacaagatcacagagtacctgtgcgagccactccggaagtgcctgaaggacgaggatccatatgtgcgcaagacagcagctgtgtgcgtggccaagctccacgacatcaacgcccagctggtggaggaccagggcttcctggacacccttaaagacctcatctccgactctaaccccatggtggtggccaatgcagtggcagcgctctcagaaattgccgagtctcaccccagcagcaacctgctcgatctgaacccacagtccatcaacaagctgctgacagccctcaatgagtgcaccgagtggggccagatcttcatcctggactgcctcgccaactatatgcccaaggacgaccgcgaggcccagagcatctgtgagcgggtcacccccaggctctcccatgccaactccgctgtggtgctctctgctgtgaaggtgctgatgaagttcatggagatgttgtctaaggacttggactactacggcacactgctcaagaagctggccccacccctggtcacactgctgtcagccgagccagagctgcagtatgtggccctgcgcaacatcaatctcatcgtgcagaaaaggcctgagatcctgaagcatgagatgaaggtgttcttcgtgaagtacaacgaccctatctacgtgaagctggagaagctggacatcatgatccgcctggcctctcaggccaacatcgcccaggtgttggcagagctgaaagagtacgcaacagaagtggatgtggactttgtacggaaggctgtgcgtgctattggccgctgcgccatcaaggtggagcaatctgcggagcgctgtgtgagcacgctgctcgacctcatccagaccaaggtcaactatgtggtccaggaggccatcgtggtcatcaaggacatcttccgcaagtaccccaacaagtatgagagtgtgattgccacactgtgtgagaatctggactccctggatgagcctgaggcccgggctgccatgatctggattgtgggcgagtacgcggaacggatcgacaacgcagatgagctgctggagagcttcctcgagggcttccatgacgagagcacacaggtccagctgcagctgctgacagccattgtgaaactctttctaaagaagccaacagagacccaggagctggtgcagcaggtcctcagtttggccactcaggactcagataacccagacctgcgggaccgtggctacatctactggcgcctgctgtccacggacccggtggcagccaaggaggtggtgttggctgagaagccactcatctctgaagagacggacctcatcgagcccacactgttagacgagcttatctgctacatcggcacgctggcttccgtctaccataagcctcccagtgcctttgtggaggggggccggggcgtcgtgcacaagagcctgccacctcgcacggcctcgagtgagagcgcagagagccctgagacagcccctactggagcacctcctggggagcagccagatgtcatccccgcccagggcgacctgctgggtgacctcctcaacctggacctcggccccccagtgagcggcccacccctggccacctcctcggtgcagatgggagctgtggaccttcttggcggtggccttgacagcctgatgggggatgagcctgaagggattgggggcaccaacttcgtggcacctccaacagcagcagtaccagccaatcttggagcacccatcggcagtggcctgagtgacctctttgacctgaccagtggcgtgggcaccctgtcaggatcatatgtggcccccaaagcagtctggctcccagccatgaaggctaaggggctggagatctcaggcaccttcacccgccaggtgggctccatctccatggacctgcagctgaccaacaaggccttgcaggtcatgaccgactttgccatccagttcaaccgcaacagctttggcctggcccccgccgcccccctccaggtccacgcaccactcagccccaaccagacagtggagatctccctgcctctcagcacggtgggctcggtcatgaagatggagcctctgaacaacctccaggtggccgtgaagaacaacatcgatgtcttctacttcagcaccttgtacccactgcacatcctctttgtggaggacgggaagatggaccggcagatgttcctggccacatggaaggatattcccaatgagaatgaggcccagttccagatcagagactgccccctcaatgcagaggctgcgagcagcaagctgcagagcagcaacatcttcactgtcgccaagaggaacgtggagggccaggacatgctctaccagtccctgaagctgaccaacggcatctgggtgctggcggagctgcggatccagccgggcaaccccagctgcacgctgtccctgaagtgtcgagcaccagaggtgtcccagcacgtgtaccaggcctacgagaccatcctcaagaactgagaccccggccagcgcccaccccagccttctgcccgccccatcgaggaggcccctcgggggcagcacatcttcctcctcgcaggagggaccaggcggggctccaggccactcagtgggctccctggtcctgatggcagaacccacccgatccctggggtagggcaccaccccctcctggggtgagagcgcagtgcactcccgtgctctgggacacccctgctcctgtggctgtgatgtggggttaagtgaggtggggaccaaaggaaacagagccagagcagccacagaagctgtgcctgaagggtgagtgtggagcttgcccctccggctcacagccccggcagcccctggctccttggtctctccggttggtgttaaagggccctccactgccacctctcatgggatggaccctgccaacctggcctgggtgtgcagggaggggttccccttggtaccaggagagctgctcacttagggcctggggctcaaggagctgtaggtgccggcagaggggcagagctaggctgggaggagcccagggcctgcaccacccacttgcaaccaccaggctggtgccctgcagctgtgccagttgggccacagcctcccgagtgctgacccacatggtcaagaccaggcagaagctcccagagcccctgtctcgggctccccaccgactggcagctgcactatccccaactccccacttctgccccaagggtggtcactgcctgtgatacattcctcagtgtcgcctctgagcccaggcctcctgccacaaagactgggccgagagatggggctgggtaagcgggtgcgcctcctgtttgggtttcttcggggtttctctgtagtgtctgctgccctcctcctggcctcccaggtttcagttgtgtctgacagagcattaggttttcctgttactgctgtgtaataataaagaaagattcggcttttggcaatcacggacacttttttcccctccaccgaatgtcaggattgaaagctgcctccgagtggttggggatggttttctgaccctacggtaactagatctaatatatatcatcagaaaatatatattgtatgtttactcttattttcagaaagagaaaatgaataaaaatgatgacatcaa

SEQ ID NO: 428 - DNA, 5712 bp, Homo sapiens
cctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaag

SEQ ID NO: 429 - DNA, 5706 bp, Homo sapiens
cctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggaggcaaagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaag

SEQ ID NO: 430 - DNA, 5454 bp, Homo sapiens
cctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggaggcaaagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccaaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaaccttggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaa

SEQ ID NO: 431 - DNA, 5703 bp, Homo sapiens
cctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaactttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaag

SEQ ID NO: 432 - DNA, 5585 bp, Homo sapiens
aaccattacaccaccacctgggctgtgctctccggctggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctggtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaactttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaag

SEQ ID NO: 433 - DNA, 5743 bp, Homo sapiens
cctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaag

SEQ ID NO: 434 - DNA, 5743 bp, Homo sapiens
cctttagggtgtgtccctaattgacggggtcggggacggagagaagggtaacaccaggctgggtcggagaccggcggaggcgaggaaatcctaagagcgtgaccgttgatgatgcagggaaccgtcgggtgtgaccattgagagggaaaaggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggaggcaaagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccagttgcaaagcttgtggggagcggtcccacaaagcactttcttaaaccttgagaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaacctgttgcctccaccacggcttccctcttggctcattccaagcttggccaaattggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaagaaatggggagggggggcaggggaaatgttgccctaagaatgcttctcattcctctgttcttattgggtcctgtttttcgggagggtgggggttgggggaagcttgaccttgtgtcttcgtcaataaactcacatttacacaaaatgaag

SEQ ID NO: 435 - DNA, 5496 bp, Homo sapiens
cctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggaggcaaagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccaaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaaccttggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaa

SEQ ID NO: 436 - DNA, 5502 bp, Homo sapiens
cctgcccaccatctttgtccctggcaaagtgggttttgcgcagtggcttagacctagaaaagaatcgtgacgggcaggaaaccattacaccaccacctgggctgtgctctccggctcccgccgccacccccgccctcgccttcgcctccgcctccggtgcacattaaagatccaaagtcatgactgactccaagtatttcacaaccaataaaaaaggagaaatatttgaactaaaagctgaactcaacaatgaaaagaaagaaaagagaaaggaggctgtgaagaaagtgattgctgctatgaccgtggggaaggatgttagttctctctttccagacgtagtgaactgtatgcagactgacaatctggaactaaagaagcttgtgtatctctacttgatgaactacgccaagagtcagccagacatggccatcatggctgtaaacagctttgtgaaggactgtgaagatcctaatcctttgattcgagccttggcagtcagaaccatggggtgcatccgggtagacaaaattacagaatatctctgtgagccgctccgcaagtgcttgaaggatgaggatccctatgttcggaaaacagcagcagtctgcgtggcaaaactccatgatatcaatgcccaaatggtggaagatcagggatttctggattctctacgggatctcatagcagattcaaatccaatggtggtggctaatgccgtagcggcattatctgaaatcagtgagtctcacccaaacagcaacttacttgatctgaacccacagaacattaataagctgctgacagccctgaatgaatgcactgaatggggccagattttcatcctggactgcctgtctaattacaaccctaaagatgatcgggaggctcagagcatctgtgagcgggtaactccccggctatcccatgccaactcagcagtggtgctttcagcggtaaaagtcctaatgaagtttctagaattgttacctaaggattctgactactacaatatgctgctgaagaagttagcccctccacttgtcactttgctgtctggggagccagaagtgcagtatgtcgccctgaggaacatcaacttaattgtccagaaaaggcctgaaatcttgaagcaggaaatcaaagtcttctttgtgaagtacaatgatcccatctatgttaaactagagaagttggacatcatgattcgtttggcatctcaagccaacattgctcaggttctggcagaactgaaagaatatgctacagaggtggatgttgactttgttcgaaaagctgtgcgggccattggacggtgtgccatcaaggtggagcaatctgcagagcgctgtgtaagcacattgcttgatctaatccagaccaaagtgaattatgtggtccaagaagcaattgttgtcatcagggacatcttccgcaaataccccaacaagtatgaaagtatcatcgccactctgtgtgagaacttagactcgctggatgagccagatgctcgagcagctatgatttggattgtgggagaatatgctgaaagaattgacaatgcagatgagttactagaaagcttcctggagggttttcacgatgaaagcacccaggtgcagctcactctgcttactgccatagtgaagctgtttctcaagaaaccatcagaaacacaggagctagtccagcaggtcttgagtttggcaacacaggattctgataatcctgaccttcgagaccggggctatatttattggcgccttctctcaactgaccctgttacagctaaagaagtagtcttgtctgagaagccactgatctctgaggagacggaccttattgagccaactctgctggatgagctaatctgccacattggttctttggcctctgtgtatcataagcctcccaatgcttttgtggaaggaagtcatggaattcatcgtaaacacttgccaattcatcatgggagcactgatgcaggtgacagccctgttggcactaccactgcaacgaacctggaacagcctcaggttatcccctctcaaggtgatcttctaggggatcttttaaaccttgacctcggtcccccagtcaatgtgccacaggtgtcctccatgcagatgggagcagtggatctcctaggaggaggactagatagtctgcttggcagtgaccttggcgggggcattggaggaagtccggcagtgggacaatccttcatcccatcatcggtgcctgcaacctttgctccttcacctacacctgctgtggtcagcagtggactgaatgacctgtttgaactctccacagggataggcatggcacctggtggatatgtggctcctaaggctgtctggctacctgcagtaaaggctaaaggcttggagatttccggaacatttactcaccgccaagggcacatctatatggaaatgaacttcaccaataaagctctgcagcacatgacagattttgcaatccagtttaacaaaaatagctttggtgtcatccccagcactcctctggccatccatacaccactgatgccaaaccagagcattgatgtctccctgcctctcaataccttgggcccagtcatgaagatggaacctctgaataacctccaggtggctgtgaaaaacaatatcgatgtcttctacttcagctgcctcatcccactcaatgtgctttttgtagaagatggcaaaatggagcgccaggtcttccttgcaacatggaaggatattcccaatgaaaatgaacttcagtttcagattaaggaatgtcatttaaatgctgacactgtttccagcaagttgcaaaacaacaatgtttatactattgccaagaggaatgtggaagggcaggacatgctgtaccaatccctgaagctcactaatggcatttggattttggccgaactacgtatccagccaggaaaccccaattacacgctgtcactgaagtgtagagctcctgaagtctctcaatacatctatcaggtctacgacagcattttgaaaaactaacaagactggtccagtacccttcaaccatgctgtgatcggtgcaagtcaagaactcttaactggaagaaattgtattgctgcgtagaatctgaacacactgaggccacctagcaaggtagtaactagtctaacctgtgctaacattagggcacaacctgttggatagttttagcttcctgtgaacatttgtaaccactgcttcagtcacctcccacctcttgccacctgctgctgctatctgtccttacttgtgggcttctccatgctgtgccaatggctggctttttctacaccctcttttgagtgtagtttggtattttgtaattgagagctcatttcaaaagcagaaaaagacaacaaatattaaagcaaggaaaagtgtaactgaaacactgcactttactgttttatacttttgtacatatgagaaatcaagggattagtgcaaccagtagaaagcattgaaatgactgtcattaaccacacagtcctggaggcagagatgcagttacctaccctagcttttgatgggttctcttacctgtagtagccttatccctggtcatttggattttcagtttgcttttttctttttttcccctccaaactccttttccttggccaagccttcatgcttccccctttccatattataatctcatttgattgctctgcagttgggaacggtgatcttcttgaatgatgtttcagtgtgcaaaaactatagagcctgtcagcaccaaagctgacagaagttataccttactcctttcctttcccctgaacaaacctgctaatcccactaattcaggaatttgagtagagatggggaacaagaacccagatgctgtcccctcaccccctctcctgtatttctcaggtccagttcaaatctaaaattctacttttagagttgaaacagagtaataacttatctaaccctcttttcctacaaaggagaaagataaaaggcacaaaggttaccgccaaggcccgtcagctgtgtagtggcaaagccgagaccgagtctcctaagtccccgtcagtgtggttttcaccacaggactgtctcttgtcgttttcccctaatgccttctcctgccttttctgtgcctagtttttggctcttcacatattccatattgattttgacgctctgtatattggcatcaggtggcagctgaatatcttttgaattactcgaaggtaaagccagatgccagaatgaaggtgtagccagtgtttcccatatgcccctggagccccacttattgaggccagcagaataggtgcagagatgaagtgagcttagagatgttgcaaatgctctttatcccttcagctctctgatctgctctttcttcatgatacttagtctgcagggcatattaagatcatcccagaggttcaggcagttcctgtcatctctgaaaagactgggggatatgaaatcttccccctaccccacttaatgcgttggatatgatttttcaaagaatgcttcatgcccaaaataccagcctgtttagcagtgttacactgtttgatctgcgggcacttgttgcattgcctggcacccaatattcagggtccatgactaagactggtcttctcagatgccctgcttaaatcaggggcacttcaggctccacaggcgtcatgttggactgagacctaactcactggactcagaggaggaatcgtggaaaacaagagcaaaactaccccacacccctatttcatgtctgaaataaccctgtttcataccaaatctccaagagaaaaatatttggggaaggagggaggaaatatgtcccttgcacaccacccctgaagcacatggcagtaggaaacagcataggattgtatgtgggaggtggataggtcggtgatgtgtggagcggaaaagcaggttggtaaagttcccttcttgggacttattcctggagtcagtggatacaagtagtgcagaaggttcacactgcaaatagtgttctcatctcaaagcaaactatcattccagaaggaaaagtgtgtcagggcaagcagacaacacaatttcctatcagaatatgtccctcaacccccgaaacaaggcttctctcagcctccccaccagtgatggataacagctcctattctcagctgacctgactgagccaacccatgaactcttcactccttggggaagccacctcccatcacacccctgagcagagttagggaggaattctacttcccataaaaggacctctcctgagaggcaaaaccttggggaagtgggatggaggttgccctgcatcccccctcctctgcctgagtgtgtctttgtaatgtcagctggcatcatacaaagagcaggagaagcaaacacccagaactcttttgctggtcagagattccctgagtgtctgtcctcacccaagcctgctctgtgtctgtgttgtgaagcttgagactctggaaa

SEQ ID NO: 437 - DNA, 1957 bp, Homo sapiens
aagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgta

SEQ ID NO: 438 - DNA, 2207 bp, Homo sapiens
tgtggagcgcccgggaaacgggaccccaagaatccaactgctcccaccctgcggccgtcccggcccggggccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactgtcaaagctgcttcaggattcaatgccatggaagatgcccagaccctgaggaaggccatgaaagggctcggcaccgatgaagacgccattattagcgtccttgcctaccgcaacaccgcccagcgccaggagatcaggacagcctacaagagcaccatcggcagggacttgatagacgacctgaagtcagaactgagtggcaacttcgagcaggtgattgtggggatgatgacgcccacggtgctgtatgacgtgcaagagctgcgaagggccatgaagggagccggcactgatgagggctgcctaattgagatcctggcctcccggacccctgaggagatccggcgcataagccaaacctaccagcagcaatatggacggagccttgaagatgacattcgctctgacacatcgttcatgttccagcgagtgctggtgtctctgtcagctggtgggagggatgaaggaaattatctggacgatgctctcgtgagacaggatgcccaggacctgtatgaggctggagagaagaaatgggggacagatgaggtgaaatttctaactgttctctgttcccggaaccgaaatcacctgttgcatgtgtttgatgaatacaaaaggatatcacagaaggatattgaacagagtattaaatctgaaacatctggtagctttgaagatgctctgctggctatagtaaagtgcatgaggaacaaatctgcatattttgctgaaaagctctataaatcgatgaagggcttgggcaccgatgataacaccctcatcagagtgatggtttctcgagcagaaattgacatgttggatatccgggcacacttcaagagactctatggaaagtctctgtactcgttcatcaagggtgacacatctggagactacaggaaagtactgcttgttctctgtggaggagatgattaaaataaaaatcccagaaggacaggaggattctcaacactttgaatttttttaacttcatttttctacactgctattatcattatctcagaatgcttatttccaattaaaacgcctacagctgcctcctagaatatagactgtctgtattattattcacctataattagtcattatgatgctttaaagctgtacttgcatttcaaagcttataagatataaatggagattttaaagtagaaataaatatgtattccatgtttttaaaagattactttctactttgtgtttcacagacattgaatatattaaattattccatattttcttttcagtgaaaaattttttaaatggaagactgttctaaaatcacttttttccctaatccaatttttagagtggctagtagtttcttcatttgaaattgtaagcatccggtcagtaagaatgcccatccagttttctatatttcatagtcaaagccttgaaagcatctacaaatctctttttttaggttttgtccatagcatcagttgatccttactaagtttttcatgggagacttccttcatcacatcttatgttgaaatcactttctgtagtcaaagtataccaaaaccaatttatctgaactaaattctaaagtatggttatacaaaccatatacatctggttaccaaacataaatgctgaacattccatattattatagttaatgtcttaatccagcttgcaagtgaatggaaaaaaaaataagcttcaaactaggtattctgggaatgatgtaatgctctgaatttagtatgatataaagaaaacttttttgtgctaaaaatactttttaaaatcaattttgttgattgtagtaatttctatttgcactgtgcctttcaactccagaaacattctgaagatgtacttggatttaattaaaaagttcactttgta

SEQ ID NO: 439 - DNA, 3161 bp, Homo sapiens
ggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgattttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacattgaatggggctggatctgtgtgtaggtggctgagctaataagtgtctggctgggcgcaggtgtggctgtccgtgtcaggttcatgcccacattctgctggccactcccatctgcttctgccttcttggctg

SEQ ID NO: 440 - DNA, 2872 bp, Homo sapiens
ggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgtgagtgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgattttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacattgaatggggctggatctgtgtgtaggtggctgagctaataagtgtctggctgggcgcaggtgtggctgtccgtgtcaggttcatgcccacattctgctggccactcccatctgcttctgccttcttggctg

SEQ ID NO: 441 - DNA, 3404 bp, Homo sapiens
ggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgatggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacgatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgctttccagtttgcttttgatttgcatcttctcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgctttcatgttgttattctgtaccctatagtagcctccatgagaatctggtatttcttgctgcttggaactactttgcagtgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttactcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatggctccactggacacaaaagagggatggaatcaacaggcagggggccttttataagccttaggaaaagaaaatgaaactatttcatctttggacttttcaatactattggagtgattttttttctttctaaacagggaaaataatgttacaaaagcatcttttttgttatttgtttgcatccctcccccacaccctggtgttttaaaatgaagaaaaaaaaccatcactttttgtacaaaaactcttaatgattaaaaaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctataggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctatactggctggggatcctgccatggatgcaggagaaaaaattcaatcacaagggagtaagtgacaacaaaaagaaaaaactctgagccacagctacactgggaggggggaggaccagattttgctacttctgtcacacaagctagaaaaaccctacctctcccattgggcaggcaacctgacattccacccagttccttgccttaccatactatgtattcctcctcttggagaattaagacctgggctaaatgctccactccaggataaggctgagcagtcctagttctctagactgcctcttttataaagattggatt

SEQ ID NO: 442 - DNA, 1079 bp, Homo sapiens
ccagagtggggcacagcgaggcgctagggggaacgctggcctctgaaactagctctgggaccggggtctgcggccggcccctagctggccccgtctcccatccccagaagggtattcactggggattctgagctttggctactccagtttcccacgacacctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaattggatcatgctgatctataaagggggtgatgaatatgacaaccactgtggcaaggagcagcgtcgtgcagtggtgatgatctcctgcaatcgacacaccctagcggacaattttaaccctgtgtctgaggagcgtggcaaagtccaagattgtttctacctctttgagatggatagcagcctggcctgttcaccagagatctcccacctcagtgtgggttccatcttacttgtcacgtttgcatcactggttgctgtttatgttgttggggggttcctataccagcgactggtagtgggagccaaaggaatggagcagtttccccacttagccttctggcaggatcttggcaacctggtagcagcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggac

SEQ ID NO: 443 - DNA, 3382 bp, Homo sapiens
atcggtgggtttatctcaaggcctgagtagccggtaacaaacgagggttcccgggattggaccgacgcagccatggtaggtccagatcccgtagaagggagcggggtcccataggttacggccgattcctggagcttctggactgagggccgcgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaatgaaggtacttgtttcctttctcaataatgaaaataggcttctagttttagaaggctgagccgaaactacaccttgcctagggatcagccccactgtcttttctttgtataactaaatctgcattttcaaatgttgtcaatcacatttttcttagagctgaatatccaggctgtaattctctaaaccctttttcttgacctcattgcatcattccacaggtcttgccccgattttgtc

SEQ ID NO: 444 - DNA, 3345 bp, Homo sapiens
ggctcccggaagttccacgtcagtcagtctgacggtcagtggatcggtgggtttatctcaaggcctgagtagccggtaacaaacgagggttcccgggattggaccgacgcagccatgcctctgcgacttgatatcaaaagaaagctaactgctagatctgatcgagttaagagtgtggatctgcatcctacagagccatggatgttggcaagtctttacaatggcagtgtgtgtgtttggaatcatgaaacacagacactggtgaagacatttgaagtatgtgatcttcctgttcgagctgcaaagtttgttgcaaggaagaattgggttgtgacaggagcggatgacatgcagattagagtgttcaattacaatactctggagagagttcatatgtttgaagcacactcagactacattcgctgtattgctgttcatccaacccagcctttcattctaactagcagtgatgacatgcttattaagctctgggactgggataaaaaatggtcttgctcacaagtgtttgaaggacacacccattatgttatgcagattgtgatcaaccccaaagataacaatcagtttgccagtgcctctttggacaggactatcaaggtgtggcagttgggctcttcgtcaccaaacttcactttggaaggacatgagaaaggcgtgaattgcattgattactacagtggtggggacaagccatacctcatttcaggtgcagatgaccgtcttgttaaaatatgggattatcagaataaaacatgtgtgcagacactggaaggacatgcccaaaatgtgtcttgtgccagctttcatcctgagttgccaatcattatcacaggttcagaagatggaacagtacgtatttggcattcaagcacctaccggcttgagagcacactgaattatggaatggagagggtatggtgcgtggccagtctaagagggtcaaacaatgtcgctttgggctatgatgaagggagcatcattgttaagcttggtcgggaggaacctgccatgtccatggatgccaatggaaagataatttgggccaagcattcagaagtccagcaggccaacctaaaagcaatgggagatgctgaaattaaagatggtgaaagattgccactggcagtaaaggatatgggcagttgtgaaatataccctcagactattcagcacaatcctaatgggcggtttgtggtggtgtgtggtgatggggagtatatcatctacacagcaatggcattgagaaacaagagctttggatctgctcaggagtttgcatgggcccacgattcttcagagtatgcaataagagagagcaacagcattgtaaagatatttaagaactttaaggaaaaaaaatcatttaaaccagattttggagcagaaagtatctacggcggcttcttattgggagtcagatctgtaaatggcttagccttctatgactgggacaatacagaactcatacgaagaattgaaattcagcccaaacatattttctggtctgactctggagagctagtctgtattgctactgaggaatcattttttatccttaagtatctgtcagaaaaagtcttggctgcacaggaaacacatgagggagttactgaagatggcattgaagatgcctttgaggttcttggtgagattcaggaaattgtgaaaacagggctttgggtaggcgattgcttcatttacacaagttctgtgaacagattaaattattatgttggaggagaaatagtcaccattgcccacttggacaggacgatgtatctcctaggctacattcctaaagacaacaggctttatctgggggataaagaattgaacatcattagctattccctgctggtttcagtcctggaataccagacagctgtcatgcggagggactttagcatggctgataaggtccttcctaccattccaaaagaacagaggaccagagttgcacactttttggaaaagcagggcttcaagcagcaagctcttacagtatccacagatcctgagcatcgttttgagcttgctcttcagcttggagagttaaaaattgcataccagttagcagtggaagcagagtcagaacagaagtggaaacaacttgctgaacttgccattagtaaatgtcagtttggcctagcccaggagtgcctgcatcatgcacaggattatgggggcctgctgcttttggccactgcctctggaaatgctaatatggtgaacaagctagcagagggtgcggagagagatggcaaaaataatgtggcattcatgagctactttttacagggcaaggttgatgcctgcctagagctcttaattagaactggacggctgccagaagctgccttcttggcccgaacttacttacccagtcaggtttcaagggtagtgaaactctggagagagaatctctcaaaagtcaatcagaaagcagcagaatcccttgctgacccaacagagtatgaaaacctgttccctggattaaaagaagcctttgttgttgaagaatgggtgaaggaaacacatgctgatctgtggccagccaaacaatacccacttgtcacgccaaatgaagagagaaatgtcatggaagagggaaaagactttcagccctcaagatctacagctcaacaggaacttgatgggaaacctgcttctcctactccggttattgtggcctcccacacagccaacaaagaagaaaagagtttactcgaactagaagtagatttggataatttggaattagaagatattgacacaacagatatcaatctggatgaagatattttggatgattgactgtaatgctttccatttacctgactaaacagatcattattatatataggtattgattgctaccctgaccacagtgctttggactatgagaaacttcttagatttttatatgtaaatgctgtggaccactgggagcacaatgcccacatcatcttaagaagagtttatgtgcagcatttaaatcactgtgttttccttgttaactaaaacagacatgggctttgatttttttcatactattagaccatatctcataaaaccttttgaattaatgaaggtacttgtttcctttctcaataatgaaaataggcttctagttttagaaggctgagccgaaactacaccttgcctagggatcagccccactgtcttttctttgtataactaaatctgcattttcaaatgttgtcaatcacatttttcttagagctgaatatccaggctgtaattctctaaaccctttttcttgacctcattgcatcattccacaggtcttgccccgattttgtc

SEQ ID NO: 445 - DNA, 2801 bp, Homo sapiens
cgggcgatctcgccatcttcgccgcttcctctcaggggccgccccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatatttttattgaggtgtttgtgtgtttttcaatgtaagcatcatgagaaataaagcaaagttcaga

SEQ ID NO: 446 - DNA, 2758 bp, Homo sapiens
ccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatatttttattgaggtgtttgtgtgtttttcaatgtaagcatcatgagaaataaagcaaagttcaga

SEQ ID NO: 447 - DNA, 2638 bp, Homo sapiens
cgggcgatctcgccatcttcgccgcttcctctcaggggccgccccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatattttt

SEQ ID NO: 448 - DNA, 2905 bp, Homo sapiens
cgcgcgcgcgcgcgccggcagttcggccacgtccctggccacgtcgcgggcgatctcgccatcttcgccgcttcctctcaggggccgccgcctcctgagccgcccagccccggggccgccgcgctgcgccgaccgccaccgccgccgccgccatgaacattttccggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatctatgaaggttatctaccttgcctgctcctatgccacagtgtacctgatctacctgaaatttaaggcaacctacgatggaaatcatgataccttccgagtggagtttctggtggtccctgtgggaggcctctcatttttagttaatcacgatttctctcctcttgagatcctctggaccttctccatctacctggagtccgtggctatccttccgcagctgtttatgatcagcaagactggggaggccgagaccatcaccacccactacctgttcttcctgggcctctatcgtgctttgtatcttgtcaactggatctggcgcttctactttgagggcttctttgacctcattgctgtggtggccggcgtagtccagaccatcctatactgtgacttcttctacttgtacattacaaaagtactcaagggaaagaagctcagtttgccagcataagtgccaaagaccatcaccagcatctgtccttcagggtgctcggacagaattcttaccacagcaaaggcataagatgcttgatacggaaaatcagaaacttaactcttttgttgcagatagtcatcagtggctctgtaaaaacgcagaggaaaagagccagaaggtttctgtttaatgcatcttgccttatctttttttattactgtgtacaaagatttttttacacaaagaaacttaatgctgtattaataaattcagtgtgtagcttcaattgggatagttccaaaagtgaagattttgtgaggaataagtgcaaattttttttttattttaaaaaattctttgaaactcttaagtctttgtgtctgcaatgaaattgtactccttgacagttgatagattatatattcttccatccctcaaacttgcattccactatatttattttttggcaaaagatgagctgtatttgtttgaaatctgagacactatgttcaattggatgtatctgttcaaatttattcccacgtgacgtggaagtccttcgttggatgtcacaacactacatttaaggttggtaaggatgacttggaggtccatggttttcattaccaacattttaagattctgaatgtcgatggagtctcactgaagagtcaccaaaggtgcctgccctcctcccctgctgggaagtgtcagttggagactgtcccaagggtgctgaagaatccagtggcaggggttctggctgctttccatctgagtgtgggatgggaggggtgttcatgatcatttggatatagcaatctactctgagaaatggaacacaaggagttacctatcactttcacttataattccaaaagatgactacaaccatgtccatgctcagattcaaacagttttccatatcacttttgggtggtaagatgatttacagttttttttttaattggcagcaccactaaccattccttacattcttttttgtatgtgtggttttctttttatttaacccgcagccgacatcgtagtttcttgttttgttttgttttacagagctgttgcatgacttatgttaccatcctaaaaaacactatattaaacatggaataaattgtctttttatgaattaggctttttgaacatcctgtgttgggatttttttgtttttcaattggcaacaaaagctctgtagggctgcagacatttaaagttcacataatcatctgtaagacattatgtattttgtggaaatactagaatttttttcctgattttgccattatatggatttgctattttttgattaatgcaaaagtatatgactttgttttttatgtgatacaccataaatattaaagtgttgaatactaacagtgctgactacaagaaggatgtagtattttggctttctgcattacaacgtcttctggaggaagggagcaggatgggtttcatttgtatctagtgtgtgtcttaacatctttctaaatcggcagtgtaactgcatagtttaacttcctgtctgtctccctcattttactcttccctccttgtcttatgttttggcttttgtgtatcagagcatctttctttgcagcatcctagtcttgcttcagtttctgtggtctcttttcatcctgcttgaagattcggagtgtggaaggaggctaggaagtctggtgcagtaggtgagcagacctcttgctgcccagcccagggtgggtggggcgcacacctgtctttgtgcatgcaaatctgatacacctggcgcatcctctggagagcacaacgcatggaaaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaataaaggttaccaggtaattaatatttttattgaggtgtttgtgtgtttttcaatgtaagcatcatgagaaataaagcaaagttcaga

SEQ ID NO: 449 - DNA, 1563 bp, Homo sapiens
tcctccccctctcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacag

SEQ ID NO: 450 - DNA, 1630 bp, Homo sapiens
tcctccccctctcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggaggaagataggcctgggtggccagatgtgctgatcttttcaacagaagccataattcaggagttttcagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacag

SEQ ID NO: 451 - DNA, 1624 bp, Homo sapiens
tcctccccctctcgctctcctccctcttcccggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagcatcaactaacctggcttcacgagagcctccctggaggattctggatgattctgggagcagatcctctggaccttctccatctacctggagtcagtggccatcttgccgcagctgttcatggtgagcaagaccggcgaggcggagaccatcaccagccactacttgtttgcgctaggcgtttaccgcacgctctatctcttcaactggatctggcgctaccatttcgagggcttcttcgacctcatcgccattgtggcaggcctggtccagacagtcctctactgcgatttcttctacctctatatcaccaaagtcctaaaggggaagaagttgagtttgccggcatagccccggtcctctccatctctctcctcggcagcagcgggaggcagaggaaggcggcagaagatgaagagctttcccatccaggggtgacttttttaagaacccacctcttgtgctccccatcccgcctcctgccgggtttcagggggacagtggaggatccaggtcttggggagctcaggacttgggctgtttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacag

SEQ ID NO: 452 - DNA, 1163 bp, Homo sapiens
cggctccagctccgccgccagctccagcctttgctccccctcccaaagtcccctccccggagcggagcgcacctagggtccctcttccgtccccccagcccagctacccgttcagaccagcagcctcggggggcacccccccgccagcctgcctccctcccgctcagccctgccagggttccccagccatgaatctcttccgattcctgggagacctctcccacctcctcgccatcatcttgctactgctcaaaatctggaagtcccgctcgtgcgccggaatttcagggaagagccaggtcctgtttgctgtggtgttcactgcccgatatctggacctcttcaccaactacatctcactctacaacacgtgtatgaaggtggtctacatagcctgctccttcaccacggtctggttgatttatagcaagttcaaagctacttacgatgggaaccatgacacgttcagagtggagttcctggtcgttcccacagccattctggcgttcctggtcaatcatgacttcacccctctggagatcctctggaccttctccatctacctggagtcagtggccatcttgccgcagctgttcatggtgagcaagaccggcgaggcggagaccatcaccagccactactttttgtagttttttgccttttagacaagaaaaaaaaatctttccactctttagtttttgattctgatgactcgtttttcttctactctgtggccccaatttttataaagtgtttttgagtgtcctatgggccggggcagggtccaagatcttttcccttccccaggcccctcggctccctcccagatcccacccccagccccactggttgccaaacactaaatctgccgacacccatctgccccacctcctgccatggccatgaaccgcgacccccactaaatttctagattggggatagggagaaagggaggcccaggaaggtctcccctgattttttttcatagtaatttttttccccagagtttgaattttttggtcttctcctggttttttggcaaattaggggggcccggggctcaagtgcgggaagggggctggcccgaggatcccatggctctcacaccatgtttttgtacagaactgatggttgaatctttgttctcttgaaataaacagaag

SEQ ID NO: 453 - DNA, 4348 bp, Homo sapiens
cgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgattttcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaagcttttctaaccagacttgatttcctcatgttctagaaagatcactaatggtcaagtg

SEQ ID NO: 454 - DNA, 4403 bp, Homo sapiens
cgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaagcttttctaaccagacttgatttcctcatgttctagaaagatcactaatggtcaagtg

SEQ ID NO: 455 - DNA, 4736 bp, Homo sapiens
cgagcccggcccgcgaacgtcacgtccctgcgcgctccctgcactctcccgagctgcgctaggcgggcgccacggctgcccggcgaaggaaaccgaaaccgagtccgggcccgtccctccgcggccccatccgcccggtgcacccggggccgcgctcgccaggccgcggagcccagagctgcgcgcacgaaccgtgcgccgggagggcgtgggcgtggcgccgaagggtcccgggtcttcgacgcctctgcggcggctcctccctccttgcagttggatccctggcgggtgcggcccggcccggcccgtgagcggcgcacagaatgggccgatgctgcttctacacggcggggacgttgtccctgctcctgctggtgaccagcgtcacgctgctggtggcccgggtcttccagaaggctgtagaccagagtatcgagaagaaaattgtgttaaggaatggtactgaggcatttgactcctgggagaagccccctctgcctgtgtatactcagttctatttcttcaatgtcaccaatccagaggagatcctcagaggggagacccctcgggtggaagaagtggggccatacacctacagggaactcagaaacaaagcaaatattcaatttggagataatggaacaacaatatctgctgttagcaacaaggcctatgtttttgaacgagaccaatctgttggagaccctaaaattgacttaattagaacattaaatattcctgtattgactgtcatagagtggtcccaggtgcacttcctcagggagatcatcgaggccatgttgaaagcctatcagcagaagctctttgtgactcacacagttgacgaattgctctggggctacaaagatgaaatcttgtcccttatccatgttttcaggcccgatatctctccctattttggcctattctatgagaaaaatgggactaatgatggagactatgtttttctaactggagaagacagttaccttaactttacaaaaattgtggaatggaatgggaaaacgtcacttgactggtggataacagacaagtgcaatatgattaatggaacagatggagattcttttcacccactaataaccaaagatgaggtcctttatgtcttcccatctgacttttgcaggtcagtgtatattactttcagtgactatgagagtgtacagggactgcctgcctttcggtataaagttcctgcagaaatattagccaatacgtcagacaatgccggcttctgtatacctgagggaaactgcctgggctcaggagttctgaatgtcagcatctgcaagaatggtgcacccatcattatgtctttcccacacttttaccaagcagatgagaggtttgtttctgccatagaaggcatgcacccaaatcaggaagaccatgagacatttgtggacattaatcctttgactggaataatcctaaaagcagccaagaggttccaaatcaacatttatgtcaaaaaattagatgactttgttgaaacgggagacattagaaccatggttttcccagtgatgtacctcaatgagagtgttcacattgataaagagacggcgagtcgactgaagtctatgattaacactactttgatcatcaccaacataccctacatcatcatggcgctgggtgtgttctttggtttggtttttacctggcttgcatgcaaaggacagggatccatggatgagggaacagcggatgaaagagcacccctcattcgaacctaaacattgcctttgcttggtgaagaaactgtgtgagctgtcctgacctggacgatgacgtggggaaaccctccacctccttgcaggcttgttgcctgttgaaagaaggaaaaagacacggcgctggcaagtgataggaacattctggccagaggttaaagagcaggctgacatggctggccattaagctttataaaatcatgtgggctctgaaattgttcttttatgtgtctagcaagtatttaataaacccttgtatagtaattttgttgttgttgggtgctggtagctccagaattttgtgaccactattgtgggtaaaatgtctctgcatcacttgttaatgctactggtctaacttcattcagtatgcttcattcaccgaactttgtgctcaaaatgcgtatataccattttatgttgtattcctccatttcacttgcaaaacagaagtaaataagagttcgggacccagggtaaaatggtagcttcatccaatatatcattcaaatgcatctgatttctaaaacatattacattttatgctgatcttcagttcataattcttccaggaaaactcagtcttccaactgcaataaaatactgggtagaatcaaatgggaaaggggttgggtggggcaatacccatgagttgatagtgataagctcctaaggatttttaacttgtacttttgtgaacgaagagaatgcataaataatgttggtgaggataaagtacagatatttcatgtagaattaattgctagttatgatgcttgtggatagttaactgttttttttttagtcaaaatgatcatgctacgaaaagatgcttctgagagaatgtaatgagtaactgatttttcttcctgagtcgcccttgccaaatatgttactgtattaattaatctaatattgagtgattatttgtaaaattatgaatatgggaaatccatctatctacagcctaagttacacataagtttcagaaagtctgattagactaaagagatatttcttctgggacagccttcttcttggtaattttgaagttctttttacaagttccttcctcagtttcagttctttccagtgttttgtagctcactgtcactcactgaatagagaaacgtgtgccctatacttcctgtgacaatcattttgctgacagaatgatggatgtttaaaatattgcacaaagtactttaaagaaaggtctgttaggaccagaagcagagacaccacttttcaaaggacttcttggtttcagcataacctaagacagggaattgggagccatcatatgtcacagtgttcagaattcaagcatatttaagggcattttctttgattctcaaagttcagcattcattttgaattgagaagcctatacatttagctgacaaagtgcttatagaatttcttaacaactgaaccattcaaaaggattttttttgtttaaaactggatttcaatgtaagcaaatgaagaaaaaaatatagatttcatttccatagcttcttatccctgtattgaggtaataaattgttttactgacaatttttcctttttctacactaaaacaatatgtgatatatttcccctcttgaagaggcaattcattaaactctcaaattttctatagaatcaagatagaacctttagatactccaactcaccaaaatgtaaaaaaactaacaaaaatatttggtcttcaataatgctaaatatctacatttttagaatttatcaacatttaactagataattgggcatgtcttaattatgcatgtacttatccatactaataaaattgacaatgctagtgcatacttattggtttagtcctattatcaggatataatcatctgtgaggaggatattttaaatactgtaaatgataacagttaatgatatacacatttagactgagttgcacactggcagggagaccaaaaacattacttccatacttgtgtcatgattcttttttttttgagagagtctcactctgtcgccaggctggagtacagtggcatgatctcggctcactgcaacctctgcctcccgggttcaagcaattctcctgcctcagccacccaagtagctgggactacaggtgcgtgccaccacgcccagctaaattttgtatttttagtggagacggggtttcaccatgttggccaggatggtctcaatctcctgaccctgcgatctgcccacctcagcctcccaaagtgctgggattacaggcgtaagccaccgggcctggcctgttttatgattcttaatagttacttggtttaaatcacatttgatactatccttctgaaaagtctgagacagatctacaaactacagtcaaaattatagattaagaggaatgaatgcacctatttggctttaagttgaagatgaattatttctcatgctcattttcttgcggcagttatcttagaaagacccccaaaggctttgtgattgtaagcactgtcatgatcacagaatgcaagcttctggtaccatgatcctcaacttagagaggaagaaaccaagacagagagcttaactcacttctctcagggaaaattaggagttgagcacaggacaggaaatgggctttgccacttttagctccaggcttttctaaccagacttgatttcctcatgttctagaaagatcactaatggtcaagtggaacaagcactacacgactaacccctattggggtttttaacttaagggaggctaatttttaatttaaactgctcgagatatgagttctgcaaaaggtggtccgcatccttggccctctggacattatcactaaattgcttgtgcctgttaacaagaatactgaccagaatgctcttcatgtagcttatacagttggttcacttcatgcggttcttgacatgtttatttctacccttaatgcaatgaaatgtttcattaataaaaaaccactttatataaaa

SEQ ID NO: 456 - DNA, 3955 bp, Homo sapiens
tgtcccttcccttggtatccctatgacttacctgttggacaggtagggggaaggggagagtaatgagtctcacctgctcagagcaagggtggggcaagacacaccccatcccttccattggttttttccttagtcttactgacagagccttgtccaatcaggaggaagtaactttctatctgccaatagatgcaatgttaggatgagacctcaagttagagtccatccctagagccgactggcagtccccggggccaatggcaagcggataaacagaggcggccgtggaagaggactggaggcgaggctccgcccctccacgggacagtcaggcgagatagccagtgagctcgcaccagagggtgggcgtctcccccaggggcggagcttcgaggtggcgaggggcgtggcttggctgtcaggtctcttcgccttttgttcggttactgagttgctgccttggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcg

SEQ ID NO: 457 - DNA, 3658 bp, Homo sapiens
tgtcccttcccttggtatccctatgacttacctgttggacaggtagggggaaggggagagtaatgagtctcacctgctcagagcaagggtggggcaagacacaccccatcccttccattggttttttccttagtcttactgacagagccttgtccaatcaggaggaagtaactttctatctgccaatagatgcaatgttaggatgagacctcaagttagagtccatccctagagccgactggcagtccccggggccaatggcaagcggataaacagaggcggccgtggaagaggactggaggcgaggctccgcccctccacgggacagtcaggcgagatagccagtgagctcgcaccagagggtgggcgtctcccccaggggcggagcttcgaggtggcgaggggcgtggcttggctgtcaggtctcttcgccttttgttcggttactgagttgctgccttggccagagtccggagcagccgccgcccgaccacgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctctggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatgcg

SEQ ID NO: 458 - DNA, 3132 bp, Homo sapiens
gactggcagtccccggggccaatggcaagcggataaacagaggcggccgtggaagaggactggaggcgaggctccgcccctccacgggacagtcaggcgagatagccagtgagctcgcaccagaggtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggccgtgcgcctggccgacgggctgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacttggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccattcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacagatg

SEQ ID NO: 459 - DNA, 3487 bp, Homo sapiens
cgccagagtccggagcagccgccgcccgaccgcgccgagctcagttcgctgtccgcgccggctcccaccccggcccgaccccgacccggcccggtcaggccccatactcagtagccacgatggaggtgatgaacctgatggagcagcctatcaaggtgactgagtggcagcagacatacacctacgactcgggtatccactcgggcgccaacacctgcgtgccctccgtcagcagcaagggcatcatggaggaggatgaggcctgcgggcgccagtacacgctcaagaaaaccaccacttacacccagggggtgccccccagccaaggtgacctggagtaccagatgtccacaacagccagggccaaacgggtgcgggaggccatgtgccctggtgtgtcaggcgaggacagctcgcttctgctggccacccaggtggaggggcaggccaccaacctgcagcgactggccgagccgtcccagctgctcaagtcggccattgtgcatctcatcaactaccaggacgatgccgagctggccactcgcgccctgcccgagctcaccaaactgctcaacgacgaggacccggtggtggtgaccaaggcggccatgattgtgaaccagctgtcgaagaaggaggcgtcgcggcgggccctgatgggctcgccccagctggtggccgctgtcgtgcgtaccatgcagaataccagcgacctggacacagcccgctgcaccaccagcatcctgcacaacctctcccaccaccgggaggggctgctcgccatcttcaagtcgggtggcatccctgctctggtccgcatgctcagctcccctgtggagtcggtcctgttctatgccatcaccacgctgcacaacctgctcctgtaccaggagggcgccaagatggcgtgcgctggccgacgggcgcaaaagatggtgcccctgctcaacaagaacaaccccaagttcctggccatcaccaccgactgcctgcagctcctggcctacggcaaccaggagagcaagctgatcatcctggccaatggtgggccccaggccctcgtgcagatcatgcgtaactacagttatgaaaagctgctctggaccaccagtcgtgtgctcaaggtgctatccgtgtgtcccagcaataagcctgccattgtggaggctggtgggatgcaggccctgggcaagcacctgaccagcaacagcccccgcctggtgcagaactgcctgtggaccctgcgcaacctctcagatgtggccaccaagcaggagggcctggagagtgtgctgaagattctggtgaatcagctgagtgtggatgacgtcaacgtcctcacctgtgccacgggcacactctccaacctgacatgcaacaacagcaagaacaagacgctggtgacacagaacagcggtgtggaggctctcatccatgccatcctgcgtgctggtgacaaggacgacatcacggagcctgccgtctgcgctctgcgccacctcactagccgccaccctgaggccgagatggcccagaactctgtgcgtctcaactatggcatcccagccatcgtgaagctgctcaaccagcccaaccagtggccactggtcaaggcaaccatcggcttgatcaggaatctggccctgtgcccagccaaccatgccccgctgcaggaggcagcggtcatcccccgcctcgtccaactgctggtgaaggcccaccaggatgcccagcgccacgtagctgcaggcacacagcagccctacacggatggtgtgaggatggaggagattgtggagggctgcaccggagcactgcacatcctcgcccgggaccccatgaaccgcatggagatcttccggctcaacaccattcccctgtttgtgcagctcctgtactcgtcggtggagaacatccagcgcgtggctgccggggtgctgtgtgagctggcccaggacaaggaggcggccgacgccattgatgcagagggggcctcggccccactcatggagttgctgcactcccgcaacgagggcactgccacctacgctgctgccgtcctgttccgcatctccgaggacaagaacccagactaccggaagcgcgtgtccgtggagctcaccaactccctcttcaagcatgacccggctgcctgggaggctgcccagagcatgattcccatcaatgagccctatggagatgacatggatgccacctaccgccccatgtactccagcgatgtgccccttgacccgctggagatgcacatggacatggatggagactaccccatcgacacctacagcgacggcctcaggcccccgtaccccactgcagaccacatgctggcctaggcggcctggccccagtgacggccccctctttgcaggcttttcctcctctctagaacctccttctgttggaggccctcccatctccccgctgaaacctgcgctccttttttggggggatcctttgctgctgagcttccccaagcacggtgtgccctggcctgccttcttcttgtgtctttggtggggatggggaggcctattcctgctggccccttctgggggtggtgggcaggtgacacggagtggcttgagcttctggggatgcaggtccaccgagcccctgacccctgtctgtccccgctcccctaacaggtgcggttcctcatctgagaggctctccgtgcaggcgatggggcaagacagaaaagtgcctgagctggggaagccggggtgtaacttcctgctgcaccctgcgcctccagaggtcctccgtagggtctttcttgggatagtgttctgctcctgcttttctgtcctgggcatgggtccagggcctgacaccccctccccgcccctgtggccctggccactaaagcttcagactcaagtacccattctgttttcccccagcaacgcccctccaaacctccagcctccctgtctccagctgcctgggcccggaagggctttggttccttctctgggtctgattttctcactgaactccaccgaccaactgccctaagcccccagggcctccagggcccaggttcgagacccaaacccccaaaatccaaaacttctcttgaaaagttcagggaccgtccaggggagatggggaggagatatggagtgagtcacctgctccagaagatgccagcttctctctccagggtgcttagttggctttgcccacccctcactccccagggagctccggggacagcttcctcacacccctgtcccacccacacagctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgtttttggttattggtttttttgtatagaccaaagcaaagaaaataaaaataacacag

SEQ ID NO: 460 - DNA, 2342 bp, Homo sapiens
agctgccgctgtcgtctttgcttcagccgcagtcgccactggctgcctgaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaactaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatgg

SEQ ID NO: 461 - DNA, 2475 bp, Homo sapiens
ggagacaccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactctgtggcccaggctggagcgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggcattaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatgaaaaagaaaaaaaaaaaaaaagaaggagtcggggccgggcgtggtggctcacgcctgtaatcccagcactttggg

SEQ ID NO: 462 - DNA, 2314 bp, Homo sapiens
ggagacaccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttctttctttttttttttttttttaagacggattctcactcttgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatataaatgtataaatatatattttatttttttttaaatccttggagcttctggttcctatcagttcctgttgttaatcgtagaaccgttgtcccttcccccattcccgtatccatcatgttctttttcttttaaatatcaatataaaggtaaaagaaggac

SEQ ID NO: 463 - DNA, 4309 bp, Homo sapiens
aggagagccggaggagggggaaggagggaggggagagcggtggcggcggctgcgccgggctgtgagtctctcgccgccggaggaagatgaggctgaagattgggttcatcttacgcagtttgctggtggtgggaagcttcctggggctagtggtcctctggtcttccctgaccccgcggccggacgacccaagcccgctgagcaggatgagggaagacagagatgtcaatgaccccatgcccaaccgaggcggcaatggactagctcctggggaggacagattcaaacctgtggtaccatggcctcatgttgaaggagtagaagtggacttagagtctattagaagaataaacaaggccaaaaatgaacaagagcaccatgctggaggagattcccagaaagatatcatgcagaggcagtatctcacatttaagcctcagacattcacctaccatgatcctgtgcttcgcccagggatcctcggtaactttgaacccaaagaacctgagcctcctggagtggttggtggccctggagagaaagccaagccattggttttgggaccagaattcaaacaagcaattcaagccagcattaaagagtttggatttaacatggtggcaagtgacatgatctcactggaccgcagcgtcaatgacttacgccaagaagaatgcaagtattggcattatgatgaaaacttgctcacttcgagcgttgtcattgtcttccataatgaaggatggtcaaccctcatgagaacagtccacagtgtaattaaaaggactccaaggaaatatttagcagaaattgtgttaattgacgatttcagtaataaagaacacttaaaagaaaaactggatgaatatattaagctgtggaatggcctagtgaaggtatttcgaaatgaaagaagggaaggtttaattcaagcacgaagtattggtgctcagaaggctaaacttggacaggttttgatataccttgatgcccactgtgaggtggcagttaactggtatgcaccacttgtagctcccatatctaaggacagaaccatttgcactgtgccgcttatagatgtcataaatggcaacacatatgaaattataccccaagggggtggtgatgaagatgggtatgcccgaggagcatgggattggagtatgctctggaaacgggtgcctctgacccctcaagagaagagactgagaaagacaaaaactgaaccgtatcggtccccagccatggctgggggattatttgccattgaacgagagttcttctttgaattgggtctctatgatccaggtctccagatttggggtggtgaaaactttgagatctcatacaagatatggcagtgtggtggcaaattattatttgttccttgttctcgtgttggacatatctaccgtcttgagggctggcaaggaaatcctccgcccatttatgttgggtcttctccaactctgaagaattatgttagagttgtggaggtttggtgggatgaatataaagactacttctatgctagtcgtcctgaatcgcaggcattaccatatggggatatatcggagctgaaaaaatttcgagaagatcacaactgcaaaagttttaagtggttcatggaagaaatagcttatgatatcacctcacactaccctttgccacccaaaaatgttgactggggagaaatcagaggcttcgaaactgcttactgcattgatagcatgggaaaaacaaatggaggctttgttgaactaggaccctgccacaggatgggagggaatcagcttttcagaatcaatgaagcaaatcaactcatgcagtatgaccagtgtttgacaaagggagctgatggatcaaaagttatgattacacactgtaatctaaatgaatttaaggaatggcagtacttcaagaacctgcacagatttactcatattccttcaggaaagtgtttagatcgctcagaggtcctgcatcaagtattcatctccaattgtgactccagtaaaacgactcaaaaatgggaaatgaataacatccatagtgtttagagagaaaaaaataaaccaataacctacctactgacaagtaaatttatacaggactgaaaaccgcctgaaacctgctgcaactattgttattaactctgtatagctccaaacctggaacctcctgatcagtttgaaggacattgataaactgtgattttacaataacattatcatctgcagttactgtttacaagactgcttttaccttaaactttgtagatgtttacatctttttgttgtgttttaagatgatgttggtaatttgtgcctttagctctgttttattagacagagttaaagcatgttgtcttctttgggattacactcaggggtctgaaaggcagtttgatttttatttttaacacacttgaaaaaaggttggagtagccagactttcatatataacttggtgattatcaacctgttgtgtctttatttaattttacatctttttgaagcactgccacaggttattagccaaggtggccttccttcacagtcatgctgcttttttgaaaggtgaatttcaacacatttagtgcctctttcatttctcagtatatatttcaagagcttgtgatgaaatctataggatggtaatgatggacttgtcacctgtatggggaatacttttactactcagaaatgaatttatgtgctgccatttgctataaagttgaactttgtatggcttgaaaaagaaatgacaatatggaacatcccaaggctgtcccatagggttggaagttgtgtagcattcactcccttacctactggcattcccagtgccctctgtccatacctacttctaggattgcaaaggagtcttccaactagagaaaaattgtccactgacatttgggatttacttttctccaatacctgccaatacagaaaactattatcagttgttattgttatcccttgaaagcgagggtgacaaaaacaacaaaacaccgttataaacacatcaaaggttcattctgactgaggtaagactttccaagcccttgttagattaggccttataaaacttgtgtgcattataacctaagctgtgcaacctgtgaagccaagagtgaactgatgtttcatttatattttcatccaaatgacattatctgcacgtttttaaaatttaaaaacaaaggactatttaaaaatacagtttattaacaaacgtgaactactttctgttacattaggtgttccctagtgtttcttaatttctttttagaaagtgtatttttattagtatttttccggtgaacagaagatttgtttggatttaaacatttactaagacagtacctattaggaaaaccaaatattgcaaatggtcaattcgattttaatttctcaaaagatactctgttatccagaagattaaaatgcctacattgagtgcttaaaaaaaaaaaaacaactgtgatgatgtgagcagaatggcaagtaagttaagcatttttgatcctgtaatcatggtatcattacaatgaaaggaattcacaaactactgccagaggaagtttgttttttaatttaagagggaaatataacctataaatttgtttcttccaagcttagctcttaaatttggagactcaaagttaaacatcctcaacagagttttatttataattttgaattgtcaatttgtattttgctactgatctgtgatcaaccattttaactttcatctctagggatgtttaacatttataattgcaaaataaaccaactataaaaaaagaaactaagagagaattggtactttaattacttgtgtgtttgcaaataggctccattttccatgttgagtagattataaccttattaactatgcataggcctaagaaaggtggcaatgaactgtgcatgtaaattttaaatgggtactttgtgcaattcgttaaaagaagatactctatgaatatgattctatatattgaaatcagaaaacctaccaaacaaaaacatcagaagctgctgccataatgactattttctactgtaggctgctttggaaataattcccatatccttgctttgtaagttggtaatatcactatgcatttctacacattttataaatttgatttatgcagattttgatacactgtatgtttctgtagaaattgtataaatattcaaaattttattaggataaatttgagaaacttacgtatatcttaattctgggttgcttgttttttaggtgacaaaaataaaatattgtattttaattc

SEQ ID NO: 464 - DNA, 3001 bp, Homo sapiens
ccccactgccacgttcgacgaaggaacgcgcagagtgcgcgcatcccttggccaatcaggaggcgcagagtccgtgctaccgaaaggggcagccattccagacccgtggaaggtgcaggcgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgttccaccttggccaggcctcctcggagaagcttgtcccccgtgtgggagggacggagccggactggacatggtcactcagtaccgcctgcagtgtcgccatgactgatcatggctcttgcatttttgggtaaatggagacttccggatcctgtcagggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacctgtccttgcctcgggtttatgatctcaccaagcccggagagctgggctggaatgcggacgccaaggccatctgccaggccttagtggggttactggtgctgagaggcctcgcccctgggacgag

SEQ ID NO: 465 - DNA, 2714 bp, Homo sapiens
ccccactgccacgttcgacgaaggaacgcgcagagtgcgcgcatcccttggccaatcaggaggcgcagagtccgtgctaccgaaaggggcagccattccagacccgtggaaggtgcaggcgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcaggggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 466 - DNA, 2492 bp, Homo sapiens
ccccactgccacgttcgacgaaggaacgcgcagagtgcgcgcatcccttggccaatcaggaggcgcagagtccgtgctaccgaaaggggcagccattccagacccgtggaaggtgcaggcgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaagtacctgctggtggagttctatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcagggtatttgcctcctcggagaagcttgtcccccgtgtgggagggacggagccggactggacatggtcactcagtaccgc

SEQ ID NO: 467 - DNA, 2560 bp, Homo sapiens
cgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaaatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacagctggcagagaggctgatgacatcgtgaactggctgaagaagcgcacgggcccggctgccaccaccctgcctgacggcgcagctgcagagtccttggtggagtccagcgaggtggctgtcatcggcttcttcaaggacgtggagtcggactctgccaagcagtttttgcaggcagcagaggccatcgatgacataccatttgggatcacttccaacagtgacgtgttctccaaataccagctcgacaaagatggggttgtcctctttaagaaggtgagccggaacaactttgaaggggaggtcaccaaggagaacctgctggactttatcaaacacaaccagctgccccttgtcatcgagttcaccgagcagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacaggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 468 - DNA, 2441 bp, Homo sapiens
cgaaagccaccaattagaagccaaggcagaaaaagttcttgtcgggagccaatgagaggctaagaaagacagcgagcgcgaggtcctcggccaatcccgaacgaaggccagggagcactcaggagcgtttccgaatccggggccaggcctggtgtgagtgtccaatccgagagcggcaaagacgagcctcgaagtccgccggccaatcgaaggcgggccccagcggcgcgtgcgcgccgcggccagcgcgcgcgggcgggggggcaggcgcgccccggacccaggatttataaaggcgaggccgggaccggcgcgcgctctcgtcgcccccgctgtcccggcggcgccaaccgaagcgccccgcctgatccgtgtccgacatgctgcgccgcgctctgctgtgcctggccgtggccgccctggtgcgcgccgacgcccccgaggaggaggaccacgtcctggtgctgcggaaaagcaacttcgcggaggcgctggcggcccacaaatgccccttggtgtggccactgcaaggctctggcccctgagtatgccaaagccgctgggaagctgaaggcagaaggttccgagatcaggttggccaaggtggacgccacggaggagtctgacctggcccagcagtacggcgtgcgcggctatcccaccatcaagttcttcaggaatggagacacggcttcccccaaggaatatacaggacgtggagtcggactctgccaagcagtttttgcaggcagcagaggccatcgatgacataccatttgggatcacttccaacagtgacgtgttctccaaataccagctcgacaaagatggggttgtcctctttaagaagtttgatgaaggccggaacaactttgaaggggaggtcaccaaggagaacctgctggactttatcaaacacaaccagctgccccttgtcatcgagttcaccgagcagacagccccgaagatttttggaggtgaaatcaagactcacatcctgctgttcttgcccaagagtgtgtctgactatgacggcaaactgagcaacttcaaaacagcagccgagagcttcaagggcaagatcctgttcatcttcatcgacagcgaccacaccgacaaccagcgcatcctcgagttctttggcctgaagaaggaagagtgcccggccgtgcgcctcatcaccctggaggaggagatgaccaagtacaagcccgaatcggaggagctgacggcagagaggatcacagagttctgccaccgcttcctggagggcaaaatcaagccccacctgatgagccaggagctgccggaggactgggacaagcagcctgtcaaggtgcttgttgggaagaactttgaagacgtggcttttgatgagaaaaaaaacgtctttgtggagttctatgccccatggtgtggtcactgcaaacagttggctcccatttgggataaactgggagagacgtacaaggaccatgagaacatcgtcatcgccaagatggactcgactgccaacgaggtggaggccgtcaaagtgcacagcttccccacactcaagttctttcctgccagtgccgacaggacggtcattgattacaacggggaacgcacgctggatggttttaagaaattcctggagagcggtggccaggatggggcaggggatgatgacgatctcgaggacctggaagaagcagaggagccagacatggaggaagacgatgatcagaaagctgtgaaagatgaactgtaatacgcaaagccagacccgggcgctgccgagacccctcgggggctgcacacccagcagcagcgcacgcctccgaagcctgcggcctcgcttgaaggagggcgtcgccggaaacccagggaacctctctgaagtgacacctcacccctacacaccgtccgttcacccccgtctcttccttctgcttttcggtttttggaaagggatccatctccaggcagcccaccctggtggggcttgtttcctgaaaccatgatgtactttttcatacatgagtctgtccagagtgcttgctaccgtgttcggagtctcgctgcctccctcccgcgggaggtttctcctctttttgaaaattccgtctgtgggatttttagacatttttcgacatcaggggtgtcccccatgcctggaagaggagctggtggctgccagccctggggcccggcacaggcctgggccttccccttccctcaagccagggctcctcctcctgtcgtgggctcattgtgaccactggcctctctacagcacggcctgtggcctgttcaaggcagaaccacgacccttgactcccgggtggggaggtggccaaggatgctggagctgaatcagacgctgacagttcttcaggcatttctatttcacaatcgaattgaacacattggccaaataaagttgaaattttaccacc

SEQ ID NO: 469 - DNA, 1806 bp, Homo sapiens
tgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacttgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaag

SEQ ID NO: 470 - DNA, 2140 bp, Homo sapiens
tgagagtcctctagacaggcgctcctcgcagcaccgtagtgcgcttgcgctgagcagcccgcgagggcggaagtgggagctgcgaccgcgctccctgtgaggtgggcaagcggcgaaatggcgccctccgggagtcttgcagttcccctggcagtcctggtgctgttgctttggggtgctccctggacgcacgggcggcggagcaacgttcgcgtcatcacggacgagaactggagagaactgctggaaggagactggatgatagaattttatgccccgtggtgccctgcttgtcaaaatcttcaaccggaatgggaaagttttgctgaatggggagaagatcttgaggttaatattgcgaaagtagatgtcacagagcagccaggactgagtggacggtttatcataactgctcttcctactatttatcattgtaaagatggtgaatttaggcgctatcagggtccaaggactaagaaggacttcataaactttataagtgataaagagtggaagagtattgagcccgtttcatcatggtttggtccaggttctgttctgatgagtagtatgtcagcactctttcagctatctatgtggatcaggacttgccataactactttattgaagaccttggattgccagtgtggggatcatatactgtttttgctttagcaactctgttttccggactgttattaggactctgtatgatatttgtggcagattgcctttgtccttcaaaaaggcgcagaccacagccatacccatacccttcaaaaaaattattatcagaatctgcacaacctttgaaaaaagtggaggaggaacaagaggcggatgaagaagatgtttcagaagaagaagctgaaagtaaagaaggaacaaacaaagactttccacagaatgccataagacaacgctctctgggtccatcattggccacagataaatcctagttaaattttatagttatcttaatattatgattttgataaaaacagaagattgatcattttgtttggtttgaagtgaactgtgacttttttgaatattgcagggttcagtctagattgtcattaaattgaagagtctacattcagaacataaaagcactaggtatacaagtttgaaatatgatttaagcacagtatgatggtttaaatagttctctaatttttgaaaaatcgtgccaagcaataagatttatgtatatttgtttaataataacctatttcaagtctgagttttgaaaatttacatttcccaagtattgcattattgaggtatttaagaagattattttagagaaaaatatttctcatttgatataatttttctctgtttcactgtgtgaaaaaaagaagatatttcccataaatgggaagtttgcccattgtctcaagaaatgtgtatttcagtgacaatttcgtggtctttttagaggtatattccaaaatttccttgtatttttaggttatgcaactaataaaaactaccttacattaattaattacagttttctacacatggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgg

SEQ ID NO: 471 - DNA, 9589 bp, Homo sapiens
ccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccgggctcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttg

SEQ ID NO: 472 - DNA, 9588 bp, Homo sapiens
ccgaccaacaccaacacccagctccgacgcagctcctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccaggggtcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttagattatgggacctggagaaacaaatcaagcaattgaggaattatcgtgataactatcaggctttctgcaagtggctctatgatcgtaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccagcgtgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagactttt

SEQ ID NO: 473 - DNA, 5480 bp, Homo sapiens
aggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactctttttgtggcgttagatttaaggaagcagggggcatggccaacgttgagtcttggcccagtggacatagtgcggctttcccttgagcactgcccagatgcaggacctgcacatgttacaggtttgccaaaagcatcttttttttt

SEQ ID NO: 474 - DNA, 5687 bp, Homo sapiens
acatgctcctcctgtccttctggcggagcgtgcttcccgctgcggggacgttcgagcaatggcagccctgctgagatccgcgcgttggttgctgcgtgccggggcggccccgcgcctcccgctctccctgcgcctcctccctggcggcccgggccggctgcatgccgcctcctatctgcccgccgctcgcgccgggcccgtggccggaggactactgagcccagccaggctgtatgccattgctgccaaagaaaaagatattcaagaggagtccactttttcttctaggaagatttccaatcagtttgattgggctctaatgagactagatctttctgttcgaagaactggccgcattccaaagaagcttctacaaaaagtttttaatgatacctgccgctcaggtggcctaggtggtagtcatgccttgcttctactacgtagttgtggttctctcttgcctgaactaaagcttgaagagagaacagaatttgctcataggatatgggacacacttcagaaattaggtgctgtgtatgatgtgagtcactataatgctttacttaaagtctatcttcaaaatgaatataaattctcaccaactgatttcctggcaaaaatggaggaagcaaacattcaaccaaatcgagtgacataccagagattgattgcttcttattgtaatgtaggagatattgaaggtgccagcaagattcttggatttatgaaaactaaggatctcccagttacagaggcagtattcagtgcccttgtgacagggcatgccagagctggtgatatggagaatgcagaaaacattctcacagtgatgagagatgccggaattgagcctggtccagacacatacctcgcattattgaatgcatatgctgagaagggcgacattgaccatgttaagcagactctggagaaggtggagaagtccgagcttcaccttatggaccgtgatttactgcaaattatttttagcttcagtaaagctgggtatcctcagtatgtctcagaaattttggaaaaagttacatgtgaaagaagatatattccagatgcaatgaacctcattttacttttagtcactgaaaaattggaagatgtagcgttgcaaattttactagcatgccccgtatcaaaggaagatggcccaagtgtctttggcagtttctttttacaacactgtgtgactatgaatacgcctgtggagaagctaacagactactgtaagaagttaaaggaagtccagatgcactcctttcctctgcagttcaccctccattgtgctttactcgccaataaaactgatttggcaaaagccttaatgaaggctgtgaaggaggaaggttttcctatcagacctcactatttctggccattgctagttggacgtcggaaggaaaaaaatgttcaaggtataattgaaatcctcaaaggaatgcaagaattgggagtacatcctgatcaggaaacatatacagattatgtgattccatgctttgatagtgtaaactcagcacgagccattttgcaggaaaatggatgtctgtctgatagtgatatgttttctcaagctggattgagaagtgaagcagcaaatgggaacttagactttgtattatcatttttgaaatcaaatacattgcccatctcgctgcagtctataagaagtagcctactgctaggcttcaggaggtctatgaatataaatctttggagcgagataacagaattgttgtacaaggatggacgttattgccaggagcctcgaggaccgacggaagctgttggctattttctttataacttgattgacagcatgagtgactcagaggtacaggccaaggaggagcatttgagacaatacttccatcagctggagaagatgaatgtaaaaattcctgaaaatatctacagaggcattcgtaatctcctggaaagctaccatgttcctgaattgattaaggatgctcacttgttggttgagagtaagaatttagactttcaaaaaactgtgcaacttacatcatctgaattggagtccacacttgaaacactaaaagctgaaaatcaacctataagagatgtcctaaagcaactcatattagtgctttgttcagaagagaatatgcaaaaagcccttgaattgaaagcaaaatatgaatccgacatggttactggtggctatgcagctttaataaatttatgctgtcgacatgataaagtagaagatgccttgaacttgaaagaagaatttgaccgcttagattcatctgctgtccttgacaccggcaagtatgtaggccttgtaagagtattggcaaagcatggcaagctccaagatgctattaacattctgaaggagatgaaagagaaggatgttcttatcaaagatacaacagccttgtcctttttccacatgctaaatggcgcagctttaagaggtgaaattgaaacagtaaaacagttgcatgaagccatcgtgactctagggttagcagaaccatccaccaacataagtttcccattggtcactgtacacttggaaaagggcgacctatctactgctcttgaggtcgccattgactgctatgaaaagtataaagtattaccaaggattcatgatgtcttgtgtaaactggtagagaaaggcgagactgatctaattcagaaagcaatggactttgtgagccaagaacaaggtgaaatggtgatgctctatgatctcttctttgccttcctacaaacaggaaattacaaagaggccaagaagatcattgagactccagggattagagctcgatctgcaaggcttcagtggttttgtgacagatgtgttgcaaataatcaggttgaaactctggaaaaattagtggagctgacacagaagctatttgaatgtgatagagaccagatgtactacaatctgctaaaactgtataaaataaacggtgactggcaaagagctgatgcagtctggaataaaatccaagaagaaaatgttattcctcgtgaaaagacattaagattattagcagaaatccttagagagggtaaccaggaagttccgtttgacgtacctgagttgtggtatgaagatgaaaaacattccctgaattcttcgtcagcctcaaccacagaacctgatttccagaaagatatattgattgcctgccgattgaaccaaaaaaaaggggcatatgatattttcctgaatgcaaaagagcaaaacattgtgtttaatgctgaaacctacagcaatctcattaaattactgatgtcagaagattattttacacaagcaatggaagtgaaagcattcgcggagacccacatcaagggcttcacactgaacgatgctgccaacagccgcctcatcataacgcaagttaggcgggattatttgaaagaggctgtgacaacactgaaaacagtattggatcagcagcagaccccttctaggttagcagtgacccgtgtcatccaggcattggccatgaagggtgatgttgaaaacatagaagtagttcagaagatgttaaatggactcgaagactccattggactttcaaaaatggttttcatcaataacattgctttggctcaaataaagaataataacatagatgccgcaatagaaaacattgaaaatatgcttacttcagagaataaagtcattgaaccccaatacttcggcttggcatacttattcagaaaagtaatagaggagcagttggaaccagcagttgaaaagataagcatcatggcggagagattggccaatcagtttgcaatttataaacctgtcactgattttttccttcaacttgtggatgcaggcaaggtggatgatgccagagctctcctacagagatgtggtgcaattgctgaacaaaccccgattttgttgttgttcctccttaggaattctaggaaacaaggaaaggcatcaactgtgaaatctgtgttagaattgattcctgaattaaatgaaaaggaagaagcatacaattccctcatgaaaagctatgtctcagagaaagatgtcacatctgctaaagcactgtatgaacatttgactgcaaagaatacaaaattggatgatctgtttctaaagcgttacgcatctttgctgaagtatgctggagagcctgtccctttcattgaaccccctgaaagctttgaattttatgcacagcagctaagaaaattgagggaaaactcttcttgaaataaccaggcgatactttgttttgtatatatttgtgattctgtgtctacatgttattttgaagtatatctgagggaaaaataaatgaaaattttctttatgtacttatgtatgtgtgatgcatgttcaaagtcttattgaccataactctgtgcacttggttattggacatttttggagtttttttctctgggaaaaatcgatagtgttttcttcaatgctgctgctgtgtgaagccatactttttcaggattcttcccctaattggctctttggtttccctgctctgtttcatttatttcattaaaatgttattcctttatttaagattcacttattagtctgctgtttctctgaaaaattttagagctaggtatagtgaccgtgaactttctaacgcataatattctgtgatacagccattccgtacatgtgtgaagtcctgcataactttcgaactttgttaaatgttggcactaggagtcatcagatctaggcttcatcattttccagtgagaagcagagacccaaagggcctgttacttgtgcttggtcaggggactgtctgtcatgcctggaggctcttcggcacacttccccatctttcccttctgccactgtggcttcaagcacctctgttcatagagcgtctctgaaattgagtctcggtcatgacttatcccgaagtagagcaatgtgtttcctctcattgtagtttcaggactttgtcagtacaagctctgccctaggcttgttactttatactcatatcctgaaaagatgtgatttcatctatgaaggggtaaaatattggtttgtatttaattgtttgaaataaaagtgatccctatattgaatctcatgcctgttaatatctacactgtaagtagtgacttcaaaaaaattctaagataggtagtcaggagagtttgccattataaaaggtgtcttaataatatggaatattgacctaactggagatgaggtaattaattaccgaaatgttgaaaatgttttgagaactctccccattttggggtattccttgttcatttgaatttggtgactccctactgttccagtttcagtgccaacttgggtcacactgttcacatcaggggagaccttgccttggggacgtaggcgggcctcttgcaacttgtgctgttgaccttctgtcttgtggaactctctctcctgcatctgctacctgcccgcagatggtgtgagggagggttgatggcgggaagccaggaagtagatgtcatcatggtattggccaggcttttacttcaactctttttgtggcgttagatttaaggaagcagggggcatggccaacgttgagtcttggcccagtggacatagtgcggctttcccttgagcactgcccagatgcaggacctgcacatgttacaggtttgccaaaagcatcttttttttt

SEQ ID NO: 475 - DNA, 1465 bp, Homo sapiens
gctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 476 - DNA, 1292 bp, Homo sapiens
gtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 477 - DNA, 1625 bp, Homo sapiens
tcccggcctcagacacacacaccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 478 - DNA, 1273 bp, Homo sapiens
tcccggcctcagacacacacaccagcagctacacctacacgctgaccatcacaggcacacagaggcacatccacctcacatccacctcatacttgtgtactctcagggttcagtctttcatcctatccctctctgatctgtgcctcccaataccttccaagatgtttacagagacccttctccctgtgcagttaggagtgtaaggcaagagagcccctacttcatggggcagatcaagagctgagaccaaagatggtctatgttgctgaccttgtcctgtcctcctgctgtcttaaactatgatccctgctgcggtcactgaagcctttccctgtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataatgaaatcagcagagcctctgggtggatgtgtagaaggcacttcaaaatgcataaacctgttacaatgttgcca

SEQ ID NO: 479 - DNA, 1532 bp, Homo sapiens
gtggagggcacgcagacattctgggaagccacttgccccacccctgggctgcttcttcttgagatcaggaggggcgttgcccagggctggtgttgccaggtggaggcctgctgaggcagtggttgtggggatcggtctccaggcagcagggggcagcagggtcaaggagaggctaactggccacgggtggggccagcaggcgggcagaaggaggctttaaagcgcctaccctgcctgcaggtgagcagtggtgtgtgagagccaggcgtccctctgcctgcccactcagtggcaacacccgggagctgttttgtcctttgtggagcctcagcagttccctctttcagaactcactgccaagagccctgaacaggagccaccatgcagtgcttcagcttcattaagaccatgatgatcctcttcaatttgctcatctttctgtgtggtgcagccctgttggcagtgggcatctgggtgtcaatcgatggggcatcctttctgaagatcttcgggccactgtcgtccagtgccatgcagtttgtcaacgtgggctacttcctcatcgcagccggcgttgtggtctttgctcttggtttcctgggctgctatggtgctaagactgagagcaagtgtgccctcgtgacgttcttcttcatcctcctcctcatcttcattgctgaggttgcagctgctgtggtcgccttggtgtacaccacaatggctgagcacttcctgacgttgctggtagtgcctgccatcaagaaagattatggttcccaggaagacttcactcaagtgtggaacaccaccatgaaagggctcaagtgctgtggcttcaccaactatacggattttgaggactcaccctacttcaaagagaacagtgcctttcccccattctgttgcaatgacaacgtcaccaacacagccaatgaaacctgcaccaagcaaaaggctcacgaccaaaaagtagagggttgcttcaatcagcttttgtatgacatccgaactaatgcagtcaccgtgggtggtgtggcagctggaattgggggcctcgagctggctgccatgattgtgtccatgtatctgtactgcaatctacaataagtccacttctgcctctgccactactgctgccacatgggaactgtgaagaggcaccctggcaagcagcagtgattgggggaggggacaggatctaacaatgtcacttgggccagaatggacctgccctttctgctccagacttggggctagatagggaccactccttttaggcgatgcctgactttccttccattggtgggtggatgggtggggggcattccagagcctctaaggtagccagttctgttgcccattcccccagtctattaaacccttgatatgccccctaggcctagtggtgatcccagtgctctactgggggatgagagaaaggcattttatagcctgggcataagtgaaatcagcagagcctctgggtggatgtgtagaaggcacttcaaaatgcataaacctgttacaatgtt

SEQ ID NO: 480 - DNA, 1526 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtaagtttgggcatactaaaaccctgtatttaggaaatgagaaaacaaattaggacttaaggtgagattgttagtttcatgactggtattcacagctagtagcaattaaaacaatccctctcctcaaagacccttcatcatgagctcatcacagttaaatttagtaaaatgggggcaagaaaggaagatttcttaaaccaccagaattctctaaattctgatttcagtaaatatgtgattcaatataaaattttaaatgtgattaataaaaaaatttgagatgatgatacttgcagaaatcttcaaatgttaaatactaaaccaatctttagttgacctaaataatgaatttgcatgagtttttctatatgcaaacaagctgttacaaaacagcatgagttaaagacattcctagtgtgaaagtattctaagttctttgataagttctctgtatagggagaaggaactcattcattgagtaccatcaatgtctcagacactgttgaaaactttacatttattttctcatttcatatctgtaaattaaataattctattttactctgtgtgtgtccctattctttataaagtaaaaatatcagtatcacttgtctcctatacgaaacacagatattggttaggtcatgaacacaaaatctgggaagtactttgaaccctttaaatataagtacattctattattctgtgaag

SEQ ID NO: 481 - DNA, 1809 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 482 - DNA, 1964 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctggttctcgtcctgtcacccaggctggtatgcggtggtgtgatcgtagctcactgcagtctcgaactcctgggttcaagcgatccttccacttcagcctcccaagtagctggtactacagggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 483 - DNA, 1636 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtcagttgacactgttcaggtttactgagtatggatctaatgtgctatggtggaaatatgaacttgaccaagattgcaggattaaatggtctctaatttattgtagccagggtttttcatactaatactttttactttatttggaagcggacttggattgtactagggcaaatctttaaaaaaagaaacatttacaataatagagaaaaagactgtggccccattaaaaaaatgctaaattaagattggt

SEQ ID NO: 484 - DNA, 1935 bp, Homo sapiens
gcaggtggggagcttggcccgcggtcgtggttcccgccgtcctgtgcctttaaggctctcgccgctcaccagcatttggggctcctgctgtgtcggcccccagctgacttggctttaggggtcggcgtggagggttaaagaggccccggctgggtttgcggagcagccaagcctggcaaaatcgaaagggagggctcaaagagactgtatccttaacccccaaaaagctggtctaaaaggatgggaggccagaccgctgaccgttccccactctcgacagagtccagccgtgtggagcacacgatgctgcaaacttgcatgtcatctctttcaggtgtggcatttcaagggggcttgtgtcttgaaaacagcaactgtgaggacacttgatagtcatttccttcagttctgcttttgtctccctaggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 485 - DNA, 1846 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatatttta

SEQ ID NO: 486 - DNA, 2640 bp, Homo sapiens
tatgacgccggagccctctgaccgcacctctgaccacaacaaacccctactccacccgtcttgtttgtcccacccttggtgacgcagagccccagcccagaccccgcccaaagcactcatttaactggtattgcggagccacgaggcttctgcttactgcaactcgctccggccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggtatcatgtagtatgtgaaatttattcttaaacgtgactactttatttctaaataagaaattccctacctgcttcctacaagcagttcagaatgccatgccttggttgtcctagtgtgaataattttcagctactttaaaattatattgtactttctcaagcatgtcatatcctttcctattagagtatctatattacttgttactgatttacctgaaggcaatctgattaatttctaggtttttaccatattcttgtcatcttgccaattacattttaagtgttagactagactaagatgtactagttgtatagaatataactagatttattatggcaatgtttattttgtcattttgcttcatctg

SEQ ID NO: 487 - DNA, 2102 bp, Homo sapiens
ccgctgggcgtagctgcgactcggcggagtcccggcggcgcgtccttgttctaacccggcgcgccatgaccgtcgcgcggccgagcgtgcccgcggcgctgcccctcctcggggagctgccccggctgctgctgctggtgctgttgtgcctgccggccgtgtggggtgactgtggccttcccccagatgtacctaatgcccagccagctttggaaggccgtacaagttttcccgaggatactgtaataacgtacaaatgtgaagaaagctttgtgaaaattcctggcgagaaggactcagtgatctgccttaagggcagtcaatggtcagatattgaagagttctgcaatcgtagctgcgaggtgccaacaaggctaaattctgcatccctcaaacagccttatatcactcagaattattttccagtcggtactgttgtggaatatgagtgccgtccaggttacagaagagaaccttctctatcaccaaaactaacttgccttcagaatttaaaatggtccacagcagtcgaattttgtaaaaagaaatcatgccctaatccgggagaaatacgaaatggtcagattgatgtaccaggtggcatattatttggtgcaaccatctccttctcatgtaacacagggtacaaattatttggctcgacttctagtttttgtcttatttcaggcagctctgtccagtggagtgacccgttgccagagtgcagagaaatttattgtccagcaccaccacaaattgacaatggaataattcaaggggaacgtgaccattatggatatagacagtctgtaacgtatgcatgtaataaaggattcaccatgattggagagcactctatttattgtactgtgaataatgatgaaggagagtggagtggcccaccacctgaatgcagaggaaaatctctaacttccaaggtcccaccaacagttcagaaacctaccacagtaaatgttccaactacagaagtctcaccaacttctcagaaaaccaccacaaaaaccaccacaccaaatgctcaagcaacacggagtacacctgtttccaggacaaccaagcattttcatgaaacaaccccaaataaaggaagtggaaccacttcaggtactacccgtcttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttcatttaggatgctttcattgtctttaagatgtgttaggaatgtcaacagagcaaggagaaaaaaggcagtcctggaatcacattcttagcacacctacacctcttgaaaatagaacaacttgcagaattgagagtgattcctttcctaaaagtgtaagaaagcatagagatttgttcgtatttagaatgggatcacgaggaaaagagaaggaaagtgatttttttccacaagatctgtaatgttatttccacttataaaggaaataaaaaatgaaaaacattatttggatatcaaaagcaaataaaaacccaattcagtctcttctaagcaaaattgctaaagagagatgaaccacattataaagtaatctttggctgtaaggcattttcatctttccttcgggttggcaaaatattttaaaggtaaaacatgctggtgaaccaggggtgttgatggtgataagggaggaatatagaatgaaagactgaatcttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacatgtaaaacaagaaaagttgaagaagatatgtgaagaaaaatgtatttttcctaaatagaaataaatgatcccattttttggt

SEQ ID NO: 488 - DNA, 3126 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccataggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 489 - DNA, 3199 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttcatgatgatgt

SEQ ID NO: 490 - DNA, 3235 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaagggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 491 - DNA, 3328 bp, Homo sapiens
cggctcgggccacgcccacctgtcctgcagcactggatgctttgtgagttggggattgttgcgtcccatatctggacccagaagggacttccctgctcggctggctctcggtttctctgctttcctccggagaaataacagcgtcttccgcgccgcgcatggagcctcccggccgccgcgagtgtccctttccttcctggcgctttcctgggttgcttctggcggccatggtgttgctgctgtactccttctccgatgcctgtgaggagccaccaacatttgaagctatggagctcattggtaaaccaaaaccctactatgagattggtgaacgagtagattataagtgtaaaaaaggatacttctatatacctcctcttgccacccatactatttgtgatcggaatcatacatggctacctgtctcagatgacgcctgttatagagaaacatgtccatatatacgggatcctttaaatggccaagcagtccctgcaaatgggacttacgagtttggttatcagatgcactttatttgtaatgagggttattacttaattggtgaagaaattctatattgtgaacttaaaggatcagtagcaatttggagcggtaagcccccaatatgtgaaaaggttttgtgtacaccacctccaaaaataaaaaatggaaaacacacctttagtgaagtagaagtatttgagtatcttgatgcagtaacttatagttgtgatcctgcacctggaccagatccattttcacttattggagagagcacgatttattgtggtgacaattcagtgtggagtcgtgctgctccagagtgtaaagtggtcaaatgtcgatttccagtagtcgaaaatggaaaacagatatcaggatttggaaaaaaattttactacaaagcaacagttatgtttgaatgcgataagggtttttacctcgatggcagcgacacaattgtctgtgacagtaacagtacttgggatcccccagttccaaagtgtcttaaagtgtcgacttcttccactacaaaatctccagcgtccagtgcctcaggtcctaggcctacttacaagcctccagtctcaaattatccaggatatcctaaacctgaggaaggaatacttgacagtttggatgtttgggtcattgctgtgattgttattgccatagttgttggagttgcagtaatttgtgttgtcccgtacagatatcttcaaaggaggaagaagaaaggcacatacctaactgatgagacccacagagaagtaaaatttacttctctctgagaaggagagatgagagaaaggtttgcttttatcattaaaaggaaagcagatggtggagctgaatatgccacttaccagactaaatcaaccactccagcagagcagagaggctgaatagattccacaacctggtttgccagttcatcttttgactctattaaaatcttcaatagttgttattctgtagtttcactctcatgagtgcaactgtggcttagctaatattgcaatgtggcttgaatgtaggtagcatcctttgatgcttctttgaaacttgtatgaatttgggtatgaacagattgcctgctttcccttaaataacacttagatttattggaccagtcagcacagcatgcctggttgtattaaagcagggatatgctgtattttataaaattggcaaaattagagaaatatagttcacaatgaaattatattttctttgtaaagaaagtggcttgaaatcttttttgttcaaagattaatgccaactcttaagattattctttcaccaactatagaatgtattttatatatcgttcattgtaaaaagcccttaaaaatatgtgtatactactttggctcttgtgcataaaaacaagaacactgaaaattgggaatatgcacaaacttggcttctttaaccaagaatattattggaaaattctctaaaagttaatagggtaaattctctattttttgtaatgtgttcggtgatttcagaaagctagaaagtgtatgtgtggcatttgttttcactttttaaaacatccctaactgatcgaatatatcagtaatttcagaatcagatgcatcctttcataagaagtgagaggactctgacagccataacaggagtgccacttcatggtgcgaagtgaacactgtagtcttgttgttttcccaaagagaactccgtatgttctcttaggttgagtaacccactctgaattctggttacatgtgtttttctctccctccttaaataaagagaggggttaaacatgccctctaaaagtaggtggttttgaagagaataaattcatcagataacctcaagtcacatgagaatcttagtccatttacattgccttggctagtaaaagccatctatgtatatgtcttacctcatctcctaaaaggcagagtacaaagtaagccatgtatctcaggaaggtaacttcattttgtctatttgctgttgattgtaccaagggatggaagaagtaaatatagctcaggtagcactttatactcaggcagatctcagccctctactgagtcccttagccaagcagtttctttcaaagaagccagcaggcgaaaagcagggactgccactgcatttcatatcacactgttaaaagttgtgttttgaaattttatgtttagttgcacaaattgggccaaagaaacattgccttgaggaagatatgattggaaaatcaagagtgtagaagaataaatactgttttactgtccaaagacatgtttatagtgctctgtaaatgttcctttcctttgtagtctctggcaagatgctttaggaagataaaagtttgaggagaacaaacaggaattctgaattaagcacagagttgaagtttatacccgtttcacatgcttttcaagaatgtcgcaattactaagaagcagataatggtgttttttagaaacctaattgaagtatattcaaccaaatactttaatgtataaaataaatattatacaatatacttgtatagcagtttctgcttcacatttgattttttcaaatttaatatttatattagagatctatatatgtataaatatgtattttgtcaaatttgttacttaaatatatagagaccagttttctctggaagtttgtttaaatgacagaagcgtatatgaattcaagaaaatttaagctgcaaaaatgtatttgctataaaatgagaagtctcactgatagaggttctttattgctcattttttaaaaaatggactcttgaaatctgttaaaataaaattgtacatttggagatgtttca

SEQ ID NO: 492 - DNA, 1314 bp, Homo sapiens
cttttcccggcacatgcgcaccgcagcgggtcgcgcgccctaaggagtggcactttttaaaagtgcagccggagaccagcctacagccgcctgcatctgtatccagcgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggactggt

SEQ ID NO: 493 - DNA, 1566 bp, Homo sapiens
ctgcccagccctcagctgtgttattattcggtgataggtatttgctaattacttccaaaagcctcccatctgtcatcccacccagactgcgcgcttctaattcctcctaccccacatgctgtgcccaatgaaaagtatggtcagcgagcgaaggtttgcaaggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccaccgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggactggt

SEQ ID NO: 494 - DNA, 1208 bp, Homo sapiens
cgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaagattggtgggattttttgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatgtcctggactggt

SEQ ID NO: 495 - DNA, 1500 bp, Homo sapiens
ctgcccagccctcagctgtgttattattcggtgataggtatttgctaattacttccaaaagcctcccatctgtcatcccacccagactgcgcgcttctaattcctcctaccccacatgctgtgcccaatgaaaagtatggtcagcgagcgaaggtttgcaaggagacagacgagggcgaaattaagccaggcggcttccctttaaatcctcgcaaagcagaagggcccctcactctggcagcaggccttggccaaggggcctttagccctgacgacccggggaagagtctcccaaagcagaacgcccggtccggcgcccagaccaaacgcgggggaaccggaagggcgaggcctccaccgccaggtcccgccagtcccagctgcgcgcgccccccagtcccgcacccgttcggcccaggctaagttagccctcaccatgccggtcaaaggaggcaccaagtgcatcaaatacctgctgttcggatttaacttcatcttctggcttgccgggattgctgtccttgccattggactatggctccgattcgactctcagaccaagagcatcttcgagcaagaaactaataataataattccagcttctacacaggagtctatattctgatcggagccggcgccctcatgatgctggtgggcttcctgggctgctgcggggctgtgcaggagtcccagtgcatgctgggactgttcttcggcttcctcttggtgatattcgccattgaaatagctgcggccatctggggatattcccacaaggatgaggtgattaaggaagtccaggagttttacaaggacacctacaacaagctgaaaaccaaggatgagccccagcgggaaacgctgaaagccatccactatgcgttgaactgctgtggtttggctgggggcgtggaacagtttatctcagacatctgccccaagaaggacgtactcgaaaccttcaccgtgaagtcctgtcctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagattgtttgtttgttttgttttgtttgttgtttgttgtttgtttttttgccactaattttagtattcattctgcattgctagataaaagctgaagttactttatgtttgtcttttaatgcttcattcaatattgacatttgtagttgagcggggggtttggtttgctttggtttatattttttcagttgtttgtttttgcttgttatattaagcagaaatcctgcaatgaaaggtactatatttgctagactctagacaagatattgtacataaaagaatttttttgtctttaaatagatacaaatgtctatcaactttaatcaagttgtaacttatattgaagacaatttgatacataataaaaaattatgacaatg

SEQ ID NO: 496 - DNA, 2644 bp, Homo sapiens
ccgacctcagcgccccctcgcgagcgcctgccgtttctcggggcgggacgggggggcggggactgggcggagaggcgcgtgctgctgcgtgcgtgcgcgcgcgccgcgggcgggccagtgaaaccggcggccctggcacgtgacctaggaccggctcaccgggtcgcttggtggctccgtctgtctgtccgtccgcccgcgggtgccatcatggcggacgcggccagtcaggtgctcctgggctccggtctcaccatcctgtcccagccgctcatgtacgtgaaagtgctcatccaggtgggatatgagcctcttcctccaacaataggacgaaatatttttgggcggcaagtgtgtcagcttcctggtctctttagttatgctcagcacattgccagtatcgatgggaggcgcgggttgttcacaggcttaactccaagactgtgttcgggagtccttggaactgtggtccatggtaaagttttacagcattaccaggagagtgacaagggtgaggagttaggacctggaaatgtacagaaagaagtctcatcttcctttgaccacgttatcaaggagacaactcgagagatgatcgctcgttctgctgctaccctcatcacacatcccttccatgtgatcactctgagatctatggtacagttcattggcagagaatccaagtactgtggactttgtgattccataataaccatctatcgggaagagggcattctaggatttttcgcgggtcttgttcctcgccttctaggtgacatcctttctttgtggctgtgtaactcactggcctacctcgtcaatacctatgcactggacagtggggtttctaccatgaatgaaatgaagagttattctcaagctgtcacaggattttttgcgagtatgttgacctatccctttgtgcttgtctccaatcttatggctgtcaacaactgtggtcttgctggtggatgccctccttactccccaatatatacgtcttggatagactgttggtgcatgctacaaaaagaggggaatatgagccgaggaaatagcttatttttccggaaggtcccctttgggaagacttattgttgtgacctgaaaatgttaatttgaagatgtggggcagggacagtgacatttctgtagtcccagatgcacagaattatgggagagaatgttgatttctatacagtgtggcgcgcttttttaataatcatttaatcttgggaaaattcaggtgtttggtgtctgccttttttgttcttttttccagcacaacataacttaccactgatactccccctttagttattctgaattaggatatttttgctccaaattcttattttacttaaccagaagggaaaaaaagttgtattttcctgaagctacaggcactttgtcatgtgatttttgagtctcaatttaaggctttgtaaaatgaagagtagaattccaagaaaaatgagaaataattttgtaaaacttaacaaaatcactaaattaaactatatgggaggttatgaattactttttcttgggtagaccctaaaatgtcagtagcatgcaccagaatctgactcccattatgcttctaagcacatttcattgaccttgtctctcatacttcaagaaaaggacagtacattgctacattaccctagaaagtctgtgtgaggatctgccccttcagtctgttattgcaaagtaataaaatgtcacctacagggagcctctgagcctactctagttcaagaggctacctgaaaaaaaataaataagataaagggtcagcaacaacaaagaaaaagacaattacagaaaataagcaagatttggaaaggaagtataatggcacttttttcctcaaaggaagttcttgttttcacataaaatatgaaaagcagatcctgcaggagtaacccccttctttaagagccaagtatttgccagtgcttaaattacaccataccgttctaattatatataatcttttgttcttcagttttttgttttgtttcctttttgttattgttgccgaaggtgagtagttttgcatttctgatgacagccttggaaagtatatttgtaactccatgtctggtaatgccaacccaagtcgacatgggtcttaggacactgaccacctcacatgccataccctcagttaagcatgttaacatttataggaggaaaaaaatcactttgggagaaaataaaattcaactcaagcataaagcttctgtttactcaggccttctaaaaagcaggttaaaatgctctaaaatgagaaagcctgtggtttcacttatttatataactcactgggacattgccaaatgagtaagcacttaattcgctgcttctgagacttctctgtcaaaacagccccactgataatattagacagaacgagaatgcaggggtctcttccctcccctggggtttaggaagctcatgaggagctcggcttaaaatgtctttgatgtctcttcctttgtctcaaaaagtaatgtcaattttatatactatttcaatattactatctgcatttgttttaatataaaaatgtttgctgcctacctttttctcccaaaaaatctttaagtaaagatgatctgggaaaatgtgccat

SEQ ID NO: 497 - DNA, 1216 bp, Homo sapiens
cagtgccattcccttcacttgatatctgtttactttagaggaggcagtttttgagaaaggatcataaatatcctggcccagtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttggtgctt

SEQ ID NO: 498 - DNA, 1198 bp, Homo sapiens
acttgatatctgtttactttagaggaggcagtttttgagaaaggatcataaatatcctggcccagtgccccaggagctatgacaagcaaaggaacatacttgcctggagatagcctttgcgatatttaaatccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttggtgctt

SEQ ID NO: 499 - DNA, 1067 bp, Homo sapiens
ccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttggtgctt

SEQ ID NO: 500 - DNA, 4898 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 501 - DNA, 4177 bp, Homo sapiens
gttctctctctctttctctcttcttccttttttttttcccccaaaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 502 - DNA, 4859 bp, Homo sapiens
acgcggttctccctgatcccggagctgggctcagggctcggactcagtcctgcagcgcctctaggctgcggatccgcgcttcaaccacctgctttgcgctgcgtccggggaagtggggaggagacgggagggagggaggaggcggggagaggaggaaagaggcagcttacacacgccttccagtccctctactcagagcagcccggagaccgctgccgccgctgccgctgctaccaccgctgccacctgaggagacccgccgcccccccgtcgccgcctcctgcgagtccttcttagcacctggcgtttcatgcacattgccactgccattattattatcattccaatacaaggaaaataaaagaagataccagcgaaaagaaccgcttacacctttccgaattactcaagtgtctcctggaaacagagggtcgttgtccccggaggagcagccgaagggcccgtgggctggtgttgaccgggagggaggaggagttgggggcattgcgtggtggaaagttgcgtgcggcagagaaccgaaggtgcagcgccacagcccaggggacggtgtgtctgggagaagacgctgcccctgcgtcgggacccgccagcgcgcgggcaccgcggggcccgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactaacggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcaatggacaattactggcagtggaagcgtcataaaccaagcaaaggaatctccttatattaatggcaggtattatagtaaaattatcatttcccctgaagagaatgttacattaacttgcacagcagaaaaccaactggagagaacagtaaactccttgaatgtctctgctaatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatttggtagcacttacctctacagacacctgctaataaattattttctgtcaaaagaaaaaacacaagcatgtgtgagagacagtttggaaaaatcatggtcaacattcccattttcatagatcacaatgtaaatcactataattacaaattggtgttaaatcctttgggttatccactgccttaaaattatacctatttcatgtttaaaaagatatcaatcagaattggagtttttaacagtggtcattatcaaagctgtgttattttccacagaatatagaatatatatttttttcgtgtgtgtttttgttaactaccctacagatattgaatgcaccttgagataatttagtgtttttaactgatacataatttatcaagcagtacatgaaagtgtaataataaaatgtctatgtatctttagttacattcaaatttgtaactttataaacatgttttatgcttgaggaaatttttaaggtggtagtataaatggaaactttttgaagtagaccagatatgggctacttgtgactagacttttaaactttgctctttcaagcagaagcctggtttctgggagaacactgcacagcgatttctttcccaggatttacacaactttaaagggaagataaatgaacatcagatttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatattatgggaaaaaaagaaaatacgttattttgcctctaaacttttattgaagttttatttggcaggaaaaaaaattgaatcttggtcaacatttaaaccaaagtaaaaggggaaaaaccaaagttatttgttttgcatggctaagccattctgttatctctgtaaatactgtgatttcttttttattttctctttagaattttgttaaagaaattctaaaatttttaaacacctgctctccacaataaatcacaaacactaaaataaaattacttccatataaatattattttctcttttggtgtgggagatcaaaggtttaaagtctaacttctaagatatatttgcagaaagaagcaacatgacaatagagagagttatgctacaattatttcttggtttccacttgcaatggttaattaagtccaaaaacagctgtcagaacctcgagagcagaacatgagaaactcagagctctggaccgaaagcagaaagtttgccgggaaaaaaaaagacaacattattaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataataaaactgaaatatgtcttcacag

SEQ ID NO: 503 - DNA, 2539 bp, Homo sapiens
cgggacgacgccccctcctgcggcgtggactccgtcagtggcccaccaagaaggaggaggaatatggaatccaagggggccagttcctgccgtctgctcttctgcctcttgatctccgccaccgtcttcaggccaggccttggatggtatactgtaaattcagcatatggagataccattatcataccttgccgacttgacgtacctcagaatctcatgtttggcaaatggaaatatgaaaagcccgatggctccccagtatttattgccttcagatcctctacaaagaaaagtgtgcagtacgacgatgtaccagaatacaaagacagattgaacctctcagaaaactacactttgtctatcagtaatgcaaggatcagtgatgaaaagagatttgtgtgcatgctagtaactgaggacaacgtgtttgaggcacctacaatagtcaaggtgttcaagcaaccatctaaacctgaaattgtaagcaaagcactgtttctcgaaacagagcagctaaaaaagttgggtgactgcatttcagaagacagttatccagatggcaatatcacatggtacaggaatggaaaagtgctacatccccttgaaggagcggtggtcataatttttaaaaaggaaatggacccagtgactcagctctataccatgacttccaccctggagtacaagacaaccaaggctgacatacaaatgccattcacctgctcggtgacatattatggaccatctggccagaaaacaattcattctgaacaggcagtatttgatatttactatcctacagagcaggtgacaatacaagtgctgccaccaaaaaatgccatcaaagaaggggataacatcactcttaaatgcttagggaatggcaaccctcccccagaggaatttttgttttacttaccaggacagcccgaaggaataagaagctcaaatacttacacactgatggatgtgaggcgcaatgcaacaggagactacaagtgttccctgatagacaaaaaaagcatgattgcttcaacagccatcacagttcactatttggatttgtccttaaacccaagtggagaagtgactagacagattggtgatgccctacccgtgtcatgcacaatatctgctagcaggaatgcaactgtggtatggatgaaagataacatcaggcttcgatctagcccgtcattttctagtcttcattatcaggatgctggaaactatgtctgcgaaactgctctgcaggaggttgaaggactaaagaaaagagagtcattgactctcattgtagaaggcaaacctcaaataaaaatgacaaagaaaactgatcccagtggactatctaaaacaataatctgccatgtggaaggttttccaaagccagccattcagtggacaattactggcagtggaagcgtcataaaccaaacagaggaatctccttatattaatggcaggtattatagtaaaattatcatttcccctgaagagaatgttacattaacttgcacagcagaaaaccaactggagagaacagtaaactccttgaatgtctctgctataagtattccagaacacgatgaggcagacgagataagtgatgaaaacagagaaaaggtgaatgaccaggcaaaactaattgtgggaatcgttgttggtctcctccttgctgcccttgttgctggtgtcgtctactggctgtacatgaagaagtcaaagactgcatcaaaacatgtaaacaaggacctcggtaatatggaagaaaacaaaaagttagaagaaaacaatcacaaaactgaagcctaagagagaaactgtcctagttgtccagagataaaaatcatatagaccaattgaagcatgaacgtggattgtatttaagacataaacaaagacattgacagcaattcatggttcaagtattaagcagttcattctaccaagctgtcacaggttttcagagaattatctcaagtaaaacaaatgaaatttaattacaaacaataagaacaagttttggcagccatgataataggtcatatgttgtgtttggttcaattttttttccgtaaatgtctgcactgaggatttctttttggtttgccttttatgtaaattttttacgtagctatttttatacactgtaagctttgttctgggagttgctgttaatctgatgtataatgtaatgtttttatttcaattgtttatatggataatctgagcaggtacatttctgattctgattgctatcagcaatgccccaaactttctcataagcacctaaaacccaaaggtggcagcttgtgaagattggggacactcatattgccctaattaaaaactgtgatttttatcacaagggaggggaggccgagagtcagactgatagacaccataggagccgactctttgatatgccaccagcgaactctcagaaataaatcacagatgcatatagacacacatacataatggtactcccaaactgacaattttacctattctgaaaaagacataaaacagaatt

SEQ ID NO: 504 - DNA, 3983 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaacta

SEQ ID NO: 505 - DNA, 3882 bp, Homo sapiens
tggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaacta

SEQ ID NO: 506 - DNA, 3613 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggtcccctccacatcccagcagcccaagcttaatagccctccccctcaacctcaccattgtgaagcacctactatgtgctgggtgcctcccacacttgctggggctcacggggcctccaacccatttaatcaccatgggaaactgttgtgggcgctgcttccaggataaggagactgaggcttagagagaggaggcagccccctccacaccagtggcctcgtggttattagcaaggctgggtaatgtgaaggcccaagagcagagtctgggcctctgactctgagtccactgctccatttataaccccagcctgacctgagactgtcggagaggctgtctggggcctttatcaaaaaaagactcagccaagacaaggaggtagagaggggactgggggactgggagtcagagccctggctgggttcaggtcccacgtctggccaggcactgccttctcctctctgggcctttgtttccttgttggtcagaggagtgattgaaccagctcatctccaaggatcctctccactccatgtttgcaatgcttttatatggcccagccttgtaaataaccacaaggtccactccctgctccacgaagccttaagccataggcccaggatatttctgagaatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaacta

SEQ ID NO: 507 - DNA, 3505 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctgagaagagcgttcctctttgcatcctctatgagaaataccgtgactgccttacggagtccaacctcatcaaggtgcgggccctcctcgtggagccagttatcaacagctacctgctggctgagagggacctctacctggagaatccagaaatcaagatccggatccttggggagcccaagcagaaacgcaagctggtggctgaggtgtccctgcagaacccgctccctgtggccctggaaggctgcaccttcactgtggagggggccggcctgactgaggagcagaagacggtggagatcccagaccccgtggaggcaggggaggaagttaaggtgagaatggacctgctgccgctccacatgggcctccacaagctggtggtgaacttcgagagcgacaagctgaaggctgtgaagggcttccggaatgtcatcattggccccgcctaagggacccctgctcccagcctgctgagagcccccaccttgatcccaatccttatcccaagctagtgagcaaaatatgccccttcttgggccccagaccccagggcagggtgggcagcctatgggggctctcggaaatggaatgtgcccctggcccatctcagcctcctgagcctgtgggtccccactcaccccctttgctgtgaggaatgctctgtgccagaaacagtgggagccctgaccttggctgactggggctggggtgagagaggaaagacctacattccctctcctgcccagatgccctttggaaagccattgaccacccaccatattgtttgatctacttcatagctccttggagcaggcaaaaaagggacagcatgccccttggctggatcagggaatccagctccctagactgcatcccgtacctcttcccatgactgcacccagctccaggggcccttgggacagccagagctgggtggggacagtgataggcccaaggggggcctccaacccatttaatcaccatgggaaactgttgtgggcgctgcttccaggataaggagactgaggcttagagagaggaggcagccccctccacaccagtccactccctgctccacgaagccttaagccataggcccaggatatttctgagagtgaaaccatgactgtgaccaccttctgtccccagccctgtcctggttccttcctatgcccaggtaccacccttcagaccccagttctaggggagaagagccctggacacccctgctctacccatgagcctgcccgctgcaatgcctagacttcccaacagccttagctgccagtgctggtcactaaccaacaaggttggcaccccagctaccccttctttgcagggctaaggcccccaaacatagcccctgccccggaggaagcttggggaacccatgagttgtcagctttgactttatctcctgctctttctacatgactgggcctcccttgggctggaagaattggggattctctattggaggtgagatcacagcctccagggccccccaaatcccagggaaggacttggagagaatcatgctgttgcatttagaactttctgctttgcacaggaaagagtcacacaattaatcaacatgtatattttctctatacatagagctctatttctctacggttttataaaagccttgggttccaaccaggcagtagatgtgcttctgaaccgcaaggagcaaacactgaaataaaatagtttatttttcacactcaaa

SEQ ID NO: 508 - DNA, 1216 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacaggtgagctgcacgctgggatgtgggtcatgagccctgggagggggcacgaagagcactggagtaggaatcaggacatccctgccctggtcctgccccctgccaccaacactctcaatgcgctatgtggcctagagcctgtgaccaccctctccggtcctttatccaatagccatccctccagtggttgttaggatcaagg

SEQ ID NO: 509 - DNA, 2217 bp, Homo sapiens
ggatccggaagcacaggagaccaagagaccagagataccaggatgagagataggacccctggttgccaggttcgagaagtcctaggctgagtccctggaaatggtcgcacttggagggtctcgccgccagtggaaggagccaccgcccccgcccgaccatggccgaggagctggtcttagagaggtgtgatctggagctggagaccaatggccgagaccaccacacggccgacctgtgccgggagaagctggtggtgcgacggggccagcccttctggctgaccctgcactttgagggccgcaactacgaggccagtgtagacagtctcaccttcagtgtcgtgaccggcccagcccctagccaggaggccgggaccaaggcccgttttccactaagagatgctgtggaggagggtgactggacagccaccgtggtggaccagcaagactgcaccctctcgctgcagctcaccaccccggccaacgcccccatcggcctgtatcgcctcagcctggaggcctccactggctaccagggatccagctttgtgctgggccacttcattttgctcttcaacgcctggtgcccagcggatgctgtgtacctggactcggaagaggagcggcaggagtatgtcctcacccagcagggctttatctaccagggctcggccaagttcatcaagaacataccttggaattttgggcagtttgaagatgggatcctagacatctgcctgatccttctagatgtcaaccccaagttcctgaagaacgccggccgtgactgctcccgccgcagcagccccgtctacgtgggccgggtggtgagtggcatggtcaactgcaacgatgaccagggtgtgctgctgggacgctgggacaacaactacggggacggcgtcagccccatgtcctggatcggcagcgtggacatcctgcggcgctggaagaaccacggctgccagcgcgtcaagtatggccagtgctgggtcttcgccgccgtggcctgcacagtgctgaggtgcctgggcatccctacccgcgtcgtgaccaactacaactcggcccatgaccagaacagcaaccttctcatcgagtacttccgcaatgagtttggggagatccagggtgacaagagcgagatgatctggaacttccactgctgggtggagtcgtggatgaccaggccggacctgcagccggggtacgagggctggcaggccctggacccaacgccccaggagaagagcgaagggacgtactgctgtggcccagttccagttcgtgccatcaaggagggcgacctgagcaccaagtacgatgcgccctttgtctttgcggaggtcaatgccgacgtggtagactggatccagcaggacgatgggtctgtgcacaaatccatcaaccgttccctgatcgttgggctgaagatcagcactaagagcgtgggccgagacgagcgggaggatatcacccacacctacaaatacccagaggggtcctcagaggagagggaggccttcacaagggcgaaccacctgaacaaactggccgagaaggaggagacagggatggccatgcggatccgtgtgggccagagcatgaacatgggcagtgactttgacgtctttgcccacatcaccaacaacaccgctgaggagtacgtctgccgcctcctgctctgtgcccgcaccgtcagctacaatgggatcttggggcccgagtgtggcaccaagtacctgctcaacctcaacctggagcctttctctggtaaagccctgtgttcctggagcatttgttgaccgccaactgacaacatgctaggtagtgacctaaccacttagcatgtgtgatttcaccccacagacacttacatggcgctgactctggggcaggccctgtcctaagcactttataaatatcaacccacttaattcttattgcaagatgaggctggtccaagtcccctgttggaacctccaatgccaagctcaagctgagatgcgttccctctaagcccccatactgtggttgagttacttgttattctttgatgataagatctggggaatttccgtgtgctggtggacaggaagccaggccctggatggctgaaaggaatccagttgcccccacccctgcctcctttctctgctgcttctttctcttctccttcctgcctccaccctttcatgctctctcctccctcatccc

SEQ ID NO: 510 - DNA, 1914 bp, Homo sapiens
attgcagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactgaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgtaggcaggagagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcatta

SEQ ID NO: 511 - DNA, 2154 bp, Homo sapiens
gggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgtaggcaggagagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcatta

SEQ ID NO: 512 - DNA, 2202 bp, Homo sapiens
ggctgccccattgcagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactggaccgctgccagacctggccttggggactcgggctgtgttcagcctggcacgccatcacagccccagcccctggattgcctggctggagaccaatggggccacctccacagaggtgagcttgtgcgctcctcccacggcggccgtgggtcggtacctcttgaaaatccacatcgactccttccaggggtctgtgacggcctaccagctaggggagttcatcctgcttttcaatccctggtgcccagaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttc

SEQ ID NO: 513 - DNA, 1947 bp, Homo sapiens
attgcagggctagaagtggccctcacagacctccagagctccagaaataatgtgcggcaccacacggaggagatcactgtggaccacctgcttgttcgccggggccaggccttcaacctcaccctgtacttcaggaaccggagcttccagccaggcctggacaacatcatcttcgtggttgaaactgaggatgctgtctacttggacagtgaaccccagaggcaggagtatgtcatgaatgattatggcttcatctaccaaggcagcaagaactggatccgcccatgtccctggaactatggacagtttgaagacaaaatcatagacatctgcctgaagctgctagacaagagcctgcacttccagactgacccagccacagactgtgctctgcggggaagccccgtctacgtcagcagagtggtgtgtgccatgatcaacagcaatgatgataatggggtgctcaatggaaactggagtgagaattacacagacggcgccaaccctgcggagtggacgggcagcgtggccatcctgaagcagtggaacgccacaggctgccagcccgtgcgctacgggcaatgctgggtctttgctgccgtcatgtgcacagtgatgaggtgtctggggatccctacccgtgtgatcaccaacttcgactctggccacgatacagatggaaacctgatcatagatgagtattatgacaacacaggcaggattttggggaataagaagaaggatactatctggaacttccatgtctggaatgagtgctggatggcccggaaggatctgccccctgcatatggaggctggcaggtgctggacgccacacctcaggagatgagcaacggcgtctactgctgtggccctgcctctgtcagagccatcaaagaaggagaagtggacctgaactatgacacgccctttgtgttttcgatggtgaatgctgactgcatgtcctggctcgtccagggagggaaggagcagaagcttcaccaggacacgagttctgttggcaattttatcagcacaaagagcatccagagtgacgagcgggatgacatcacagagaactacaagtatgaagaaggatccctccaggagaggcaggtgtttctgaaggctctgcagaagctgaaggctagaagcttccatggctcccaaagaggagcagagttgcaaccttccaggcccacatcactgagccaggacagccctcggagcctgcatacaccttcccttcgacccagtgatgtggtgcaagtctccctgaaattcaagctgctcgacccgcccaacatgggccaggatatatgctttgtcctgctggccctcaacatgtcctcccagttcaaggacctcaaagtgaacctgagtgcccagtctctgctgcacgatggcagccccctgtccccattctggcaggacacagcgttcatcacactctctcctaaagaagcaaagacctacccctgcaaaatctcctattcccagtacagccagtacctgtcaacagacaagctgatccgcatcagtgccctgggtgaagagaaaagcagtcctgagaaaatcctggtgaacaagatcatcaccttatcttatccaagcatcacgattaatgttctaggagcagccgttgtgaaccagccactctccatacaggtgatattttcaaaccccctctcggagcaggttgaggactgtgtgctgactgtggaaggaagtggcctcttcaagaaacagcagaaagtcttccttggagtcctcaaaccccaacaccaagcaagcatcattctggagaccgtccccttcaagagtggacaaaggcagatccaagctaatatgagaagcaacaagtttaaggacattaagggttacaggaatgtttatgtagactttgcattataaattctggaacaacgcgccagacgtgtgaatttc

SEQ ID NO: 514 - DNA, 2417 bp, Homo sapiens
ggcccagcacgcggccgctctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattcaaccaccatctgctctaaccatgtagacttattgcggcctggtttctctgttacaataaaattactgtagacccaa

SEQ ID NO: 515 - DNA, 2465 bp, Homo sapiens
ggcccagcacgcggccgctctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtcactgaagcctttaagagggacaccaatagcaaaaagatgaatctgggagttggtgcctaccgggatgataacggaaagccttacgtgctgcctagcgtccgcaaggcagaggcccagattgccgcaaaaaatttggacaaggaatacctgcccattgggggactggctgaattttgcaaggcatctgcagaactagccctgggtgagaacagcgaagtcttgaagagtggccggtttgtcactgtgcagaccatttctggaactggagccttaaggatcggagccagttttctgcaaagattttttaagttcagccgagatgtctttctgcccaaaccaacctggggaaaccacacacccatcttcagggatgctggcatgcagctacaaggttatcggtattatgaccccaagacttgcggttttgacttcacaggcgctgtggaggatatttcaaaaataccagagcagagtgttcttcttctgcatgcctgcgcccacaatcccacgggagtggacccgcgtccggaacagtggaaggaaatagcaacagtggtgaagaaaaggaatctctttgcgttctttgacatggcctaccaaggctttgccagtggtgatggtgataaggatgcctgggctgtgcgccacttcatcgaacagggcattaatgtttgtctctgccaatcatatgccaagaacatgggcttatatggtgagcgtgtaggagccttcactatggtctgcaaagatgcggatgaagccaaaagggtagagtcacagttgaagatcttgatccgtcccatgtattccaaccctcccctcaatggggcccggattgctgctgccattctgaacaccccagatttgcgaaaacaatggctgcaagaagtgaaaggcatggctgaccgcatcattggcatgcggactcaactggtctccaacctcaagaaggagggttccacccacaattggcaacacatcaccgaccaaattggcatgttctgtttcacagggctaaagcctgaacaggtggagcggctgatcaaggagttctccatctacatgacaaaagatggccgcatctctgtggcaggggtcacctccagcaacgtgggctaccttgcccatgccattcaccaggtcaccaagtaatgtccctggtgcgaggaaacagagacaacctttctgtcttcagcctctgctattgagagcttcacacagacaatgagagagggtggatggtggtgagtggatcatttctttcagccacagtgtgtaacactcagcatttgaatgtttctcagaaaagaacatgtagtgacacagggcagaggcatccatggctggcgtctggaatattaaaccaaactctccccggtccttttttctccaacttttctcaaagagtttacatgtgcaagaaagtcatcgcaccaaaaaacctgtcaattatgccattgcaatatttcagaagctttaactgaagtgtcaggttcctcgtgagaaacagcacacgttagaggctttgagagaaggcctagttctgtcatgagtagtcggcctcgtgtctgtcctcccatcttggaacaaccttatcaacaggccgcactgcagaaatgatgttttatgaaaaccaatgaggctgctgccactccagcaagggaaataatgcagtttcctgtcttatttaagaaaaagagaaggctctcttttctcccttgtcattgccgttcttttccttacacgcaaagattttttaactattgcagattttcatcccattctactgcttgattgaccatcaactccatcctatcgagatttatttaagaatgaagaacataattttctgctgatgccgtaccctcacccttttcagcaaagaatagtggagagtaggaaactgtactttatctcggcatcctcttgaatgatagtgcaagtttctccagttgggatgttgtctctgcccggttggacctcctccctttgttgaatgtggtgtgcagcctctcatctcacactgtgagtccagcggcgcagggtggtaccaggaaagaggatattctaggctttgcgtgctgctagctgggttcaggcttcacccactggaaagaaccaccatctgctctaaccatgtagacttattgcggcctggtttctctgttacaataaaattactgtagacccaa

SEQ ID NO: 516 - DNA, 3663 bp, Homo sapiens
agcaaccacagggcctgggactggggggttcccagatccttgaagctcactccgcctcctcactctcactgcatttcccaccttcctgtgggccttgcggcatcttcatcactgaggcacctggttacgcttcacctcttgtttcctgccctcactgcattccctcacctctacctttttatccttccaccctaggcttctctcctccctcttccctcactcctgactcttcctcttcccagcggacggctggaggaccgctcagtctctcctctctcacttcccttcctctctctcaccttcaccacccaacacctccctccctgcctctttctttctgctccctcattctctccccaccactctcttctcgtggcccccttgcccgcgcgccctcttcccttccccttgcctcactctctcagctttcttcccacagttgagctcgggcagctctttctggggatagctatggggctttgggggaagaaagggacagtggctccccatgaccagagtccaagacgaagacctaaaaaagggcttatcaagaaaaaaatggtgaagagggaaaaacagaagcgcaatatggaggaactgaagaaggaagtggtcatggatgatcacaaattaaccttggaagagctgagcaccaagtactccgtggacctgacaaagggccatagccaccaaagggcaaaggaaatcctgactcgagatggacccaatactgttaccccaccccccaccactccagaatgggtcaaattctgtaagcaactgttcggaggcttctccctcctactatggactggggccattctctgctttgtggcctacagcatccagatatatttcaatgaggagcctaccaaagacaacctctacctgagcatcgtactgtccgtcgtggtcatcgtcactggctgcttctcctattatcaggaggccaagagctccaagatcatggagtcttttaagaacatggtgcctcagcaagctctggtaattcgaggaggagagaagatgcaaattaatgtacaagaggtggtgttgggagacctggtggaaatcaagggtggagaccgagtccctgctgacctccggcttatctctgcacaaggatgtaaggtggacaactcatccttgactggggagtcagaaccccagagccgctcccctgacttcacccatgagaaccctctggagacccgaaacatctgcttcttttccaccaactgtgtggaaggaaccgcccggggtattgtgattgctacgggagactccacagtgatgggcagaattgcctccctgacgtcaggcctggcggttggccagacacctatcgctgctgagatcgaacacttcatccatctgatcactgtggtggccgtcttccttggtgtcactttttttgcgctctcacttctcttgggctatggttggctggaggctatcatttttctcattggcatcattgtggccaatgtgcctgaggggctgttggctacagtcactgtgtgcctgaccctcacagccaagcgcatggcgcggaagaactgcctggtgaagaacctggaggcggtggagacgctgggctccacgtccaccatctgctcagacaagacgggcaccctcacccagaaccgcatgaccgtcgcccacatgtggtttgatatgaccgtgtatgaggccgacaccactgaagaacagactggaaaaacatttaccaagagctctgatacctggtttatgctggcccgaatcgctggcctctgcaaccgggctgactttaaggctaatcaggagatcctgcccattgctaagagggccacaacaggtgatgcttccgagtcagccctcctcaagttcatcgagcagtcttacagctctgtggcggagatgagagagaaaaaccccaaggtggcagagattccctttaattctaccaacaagtaccagatgtccatccaccttcgggaggacagctcccagacccacgtactgatgatgaagggtgctccggagaggatcttggagttttgttctacctttcttctgaatgggcaggagtactcaatgaacgatgaaatgaaggaagccttccaaaatgcctatttagaactgggaggtctgggggaacgtgtgctaggcttctgcttcttgaatctgcctagcagcttctccaagggattcccatttaatacagatgaaataaatttccccatggacaacctttgttttgtgggcctcatatccatgattgaccctccccgagctgcagtgcctgatgctgtgagcaagtgtcgcagtgcaggaattaaggtgatcatggtaacaggagatcatcccattacagctaaggccattgccaagggtgtgggcatcatctcagaaggcactgagacggcagaggaagtcgctgcccggcttaagatccctatcagcaaggtcgatgccagtgctgccaaagccattgtggtgcatggtgcagaactgaaggacatacagtccaagcagcttgatcagatcctccagaaccaccctgagatcgtgtttgctcggacctcccctcagcagaagctcatcattgtcgagggatgtcagaggctgggagccgttgtggccgtgacaggtgacggggtgaacgactcccctgcgctgaagaaggctgacattggcattgccatgggcatctctggctctgacgtctctaagcaggcagccgacatgatcctgctggatgacaactttgcctccatcgtcacgggggtggaggagggccgcctgatctttgacaacctgaagaaatccatcatgtacaccctgaccagcaacatccccgagatcacgcccttcctgatgttcatcatcctcggtatacccctgcctctgggaaccataaccatcctctgcattgatctcggcactgacatggtccctgccatctccttggcttatgagtcagctgaaagcgacatcatgaagaggcttccaaggaacccaaagacggataatctggtgaaccaccgtctcattggcatggcctatggacagattgggatgatccaggctctggctggattctttacctactttgtaatcctggctgagaatggttttaggcctgttgatctgctgggcatccgcctccactgggaagataaatacttgaatgacctggaggacagctacggacagcagtggacctatgagcaacgaaaagttgtggagttcacatgccaaacggccttttttgtcaccatcgtggttgtgcagtgggcggatctcatcatctccaagactcgccgcaactcacttttccagcagggcatgagaaacaaagtcttaatatttgggatcctggaggagacactcttggctgcatttctgtcctacactccaggcatggacgtggccctgcgaatgtacccactcaagataacctggtggctctgtgccattccctacagtattctcatcttcgtctatgatgaaatcagaaaactcctcatccgtcagcacccggatggctgggtggaaagggagacgtactactaaactcagcagatgaagagcttcatgtgacacaggggtgttgtgagagctgggatggggccagagattataagtttgacacaacatctgagacactaggatgaa

SEQ ID NO: 517 - DNA, 861 bp, Homo sapiens
gccatctccttcgccaaggacttcctagctggaggcatcaccgccgctatctccaagacagccgtggcatcgatcaagcgggtccagctgctgctgcagatgcagcacgccagcatgccgatggccgccgccaagcagtgcaagggcatcgtggactgcatcgtccgcatccccaaagatcagggcgtgctgtccttctggaggggcaacctggccaatgtcatccgctactcccccacgcaagccctcaatttcgccttcaaggataagtacaagcagatcttcctggcgggcgtggacaagcacacgcagttctgcaggtactttgcgggcaacctggcctctggcggcacggccgtcgtgtatcccctggatttcaccagaacccgcctggcagccgacgtgggaaagtcaggcacggagcgcgagttccgaggcctgggagactgcctagtgaagatcagcaagtccgacggcatccggggcctttaccagggcttcagcgtctccgtgcaggccatcatcatctaccaggcagcctacttcagggtgtacgatacggccaatggcatgttccccgaccccaagaacacacacatcctggtgagctggatgaccgcgcagaccgtgacggccgtggctggcgtgctctcctaccccttcgacacagtgcggcggcggacgatgatgcagtcccggcgcaaaggagctgacatcatgtacacgggcaccgtcgactgttggaggaagatcttcagagacgagcggggcgaggcctttttcaagggtgtgtggtccaacgccctcagaggcatgggggtgggggcgggcttcgtgctggtcctgtacgacgagctgaag

SEQ ID NO: 518 - DNA, 1583 bp, Homo sapiens
cacggatcggcagcgggactgagccgcgcccacgtggaagccgccgcaggcttcgcgcggggccccccgggtgcacgcgggcaggggccggggtctcccgacgcacgaccccggagagtgttaaaagggtcggagctgcccggaggcggcggcagggctgagccagcgacgccctccattcactctccgcgcccgttctccggctgtcctcccgttccgctgcccgccctgccaccatgacggaacaggccatctccttcgccaaagacttcttggccggaggcatcgccgccgccatctccaagacggccgtggctccgatcgagcgggtcaagctgctgctgcaggtccagcacgccagcaagcagatcgccgccgacaagcagtacaagggcatcgtggactgcattgtccgcatccccaaggagcagggcgtgctgtccttctggaggggcaaccttgccaacgtcattcgctacttccccactcaagccctcaacttcgccttcaaggataagtacaagcagatcttcctggggggcgtggacaagcacacgcagttctggaggtactttgcgggcaacctggcctccggcggtgcggccggcgcgacctccctctgcttcgtgtacccgctggattttgccagaacccgcctggcagcggacgtgggaaagtcaggcacagagcgcgagttccgaggcctgggagactgcctggtgaagatcaccaagtccgacggcatccggggcctgtaccagggcttcagtgtctccgtgcagggcatcatcatctaccgggcggcctacttcggcgtgtacgatacggccaagggcatgctccccgaccccaagaacacgcacatcgtggtgagctggatgatcgcgcagaccgtgacggccgtggccggcgtggtgtcctaccccttcgacacggtgcggcggcgcatgatgatgcagtccgggcgcaaaggagctgacatcatgtacacgggcaccgtcgactgttggaggaagatcttcagagatgaggggggcaaggccttcttcaagggtgcgtggtccaacgtcctgcggggcatggggggcgccttcgtgctggtcctgtacgacgagctcaagaaggtgatctaagggccgcggcctcctccacacacacacacacaccaggggaaccaagagaaccacgtagaatcctcaaccgtgcggaccatcaaccttcgagaaattccagttgtctttttcccagccgcatcctgcctgtagatggccggggaaggctctagaaaaggggcgcattgcgatccaaccatcggcagccgattccgtgtcttgatcacggggtgggagggaaccgtggcgtccctgcgtggggcccatgggtgagacactccagtactgagacctagagtccagatgcttgtaggagccaagtcgtgttctaagtatttatttaaaacaaaagaatcacgttttcccatttgtacttcagcgctagcccctgttttgcacagccgagtactggcgagtatgttctatgttgggcctcctgctgcaaaacaataaacagaggacgcagaggtc

SEQ ID NO: 519 - DNA, 4211 bp, Homo sapiens
cggagagcgcgagggaggagattctgagcgagggaggggagcgcgcccgggcagcagtgcgtgcgctcctcccggcgccacaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaggtgctggtgaccgccgtgtacctggtgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctggcggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttgcccccgacagacagagcagcccccacccgggagccttgatgggggtcaggcagaggccagcctgcactggagtctgaggcctgggacccccccctcccaccccctaacccatgtttctcattagtgtctcccgggcctgtccccaactcctccccacccctcccccatctcctctttgaaagccagaacaagagagcgctcctctcccagataggaaaagggcctctaacaaggagaaattagtgtgcggcaaaaggcagttttctttgttctcagactaatggatggttccagagaaggaaatgaaaggtgctgggtggggccgggcctccggcggcccggctgctgttcccatgtccacatctctgaggcctgcaccccctctgtctagctcggggagtccagccccagtcccgcaggctccgtggctttgggcctcacgtgcagaccctgccatgcagacccatgcccccctcccccaggcagctccaagaaagctccctgactcgccccttcaggcctggcaagctgggggcccatcgccgtggggagtccctcccaccaccctcgccgcaggcagctgcagcccccagaggggaccacaagcccaaaaaggacaaaaatgggctggcctggaatggcccagaccccagcctcccctcctccctcccatcctcacccaggccaaggcccaggggctctgccaggacaccacatgggagggggctcaggcctcagcctcaagatcttcagctgtggcctctcgggctcggcagaagggacgccggatcaggggcctggtctccagcacctgcccgagtggccgtggccaggatggggtgcgcattccgtgtgctttgcttgtggctgtgcaggctgaggtctggagccaggcccagagctggcttcagggtggggccttgagaaggggaatgtgggacaggggcgatggtgcctggtctctgagtaagatgccaggtcccaggaactcaggcttcaggtgagaaggagcggtgtgtccaggcaccgctggccggcagccctgggctgaggcacagactcatttgtcaccttctggcggcggcagccctggccccggcctccaagcagttgaaaaagctggcgcctccttggtctctaggatccaggctccacagagcacatgactagccaggcccctggcttaagaaggtcgcctaagcctaagagaagacagtcccaggagaagctggccgggaccagccaggagctgggagccacaggaagcaaaagtcagccttttcttcaagggatttccctgtctcagagcagcctttgccccagggaaatgggctctgggctggctgcctgcaccggccatgtcgacccaggacccggacacctggtcttgggctgtgttcagccactttgccttctctggactcagtttccccgtctgagaaatgagagtcgaatgctacagtatctgcagtcgcttggatctggctgttgagttgacgggttccttgaaccccacaaaatccctctccaaccacaggacccttcggctcaccaagaacggggcccaggggagtcaggcctattcgctgcacttcctgccaaactttgcccccacaagcctggtcatcagccaggcagccctcccagtgcccaagggccaccaaccccagggaaacagggccagcacagaggggccttcctcccccacagagctcccatgacatagtctgctctgggcggaagagctttgctgccagccagggatgtccagaggtcggtgcagcccctatccctgctcaggagtgggctcagagtctagcaaatgctaaggcccctcaggctgggctctgaacgaggacctggactcagagccagacagggcagcctcagacccttctctggggctcctggaccttgggccataatttctgagcctcggtttccccatctaaggaacagatgtggtcgttccgccctctcagctggatgagactgtcctggaggatccaccccggaacagacagaatggtgtctctcaggatggtgctctgagagagggcagagtggatgccccactgccctagaccctcggtagacgtggggtctctggggcggggtctgtggctgtgactgaagtcggctttcccgttgatgtcttgatgctcctatctgtgcacttaccgtaggtagggacacgtgtccatgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactcccaccatctgcaggtggtgaaaacaaaccccgtgtatctctcaataaaggtggccgaagggcctcgatgtgga

SEQ ID NO: 520 - DNA, 4131 bp, Homo sapiens
tcaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcgcgttcatcggtccccgcctgagacgcgcccactcctgcccggacttccagccccggaggcgccggacagagccgcggactccagcgcccaccatgcgcctcaacagctccgcgccgggaaccccgggcacgccggccgccgaccccttccagcgggcgcaggccggactggaggaggcgctgctggccccgggcttcggcaacgcttcgggcaacgcgtcggagcgcgtcctggcggcacccagcagcgagctggacgtgaacaccgacatctactccaaagtgctggtgaccgccgtgtacctggcgctcttcgtggtgggcacggtgggcaacacggtgacggcgttcacgctggcgcggaagaagtcgctgcagagcctgcagagcacggtgcattaccacctgggcagcctggcgctgtccgacctgctcaccctgctgctggccatgcccgtggagctgtacaacttcatctgggtgcaccacccctgggccttcggcgacgccggctgccgcggctactacttcctgcgcgacgcctgcacctacgccacggccctcaacgtggccagcctgagtgtggagcgctacctggccatctgccaccccttcaaggccaagaccctcatgtcccgaagccgcaccaagaagttcatcagcgccatctggctcgcctcggccctgctgacggtgcctatgctgttcaccatgggcgagcagaaccgcagcgccgacggccagcacgccggcggcctggtgtgcacccccaccatccacactgccaccgtcaaggtcgtcatacaggtcaacaccttcatgtccttcatattccccatggtggtcatctcggtcctgaacaccatcatcgccaacaagctgaccgtcatggtacgccaggcggccgagcagggccaagtgtgcacggtcgggggcgagcacagcacattcagcatggccatcgagcctggcagggtccaggccctgcggcacggcgtgcgcgtcctacgtgcagtggtcatcgcctttgtggtctgctggctgccctaccacgtgcggcgcctcatgttctgctacatctcggatgagcagtggactccgttcctctatgacttctaccactacttctacatggtgaccaacgcactcttctacgtcagctccaccatcaaccccatcctgtacaacctcgtctctgccaacttccgccacatcttcctggccacactggcctgcctctgcccggtgtggcggcgcaggaggaagaggccagccttctcgaggaaggccgacagcgtgtccagcaaccacaccctctccagcaatgccacccgcgagacgctgtactaggctgtgcgccccggaacgtgtccaggaggagcctggccatgggtccttgcccccgacagacagagcagcccccacccgggagccttgatgggggtcaggcagaggccagcctgcactggagtctgaggcctgggacccccccctcccaccccctaacccatgtttctcattagtgtctcccgggcctgtccccaactcctccccacccctcccccatctcctctttgaaagccagaacaagagagcgctcctctcccagataggaaaagggcctctaacaaggagaaattagtgtgcggcaaaaggcagttttctttgttctcagactaatggatggttccagagaaggaaatgaaatgtgctgggtggggccgggcctccggcggcccggctgctgttcccatgtccacatctctgaggcctgcaccccctctgtctagctcggggagtccagccccagtcccgcaggctccgtggctttgggcctcacgtgcagaccctgccatgcagacccatgcccccctcccccaggcagctccaagaaagctccctgactcgccccttcaggcctggcaagctgggggcccatcgccgtggggagtccctcccaccaccctcgccgcaggcagctgcagcccccagaggggaccacaagcccaaaaaggacaaaaatgggctggcctggaatggcccagaccccagcctcccctcctccctcccatcctcacccaggccaaggcccaggggctctgccaggacaccacatgggagggggctcaggcctcagcctcaagatcttcagctgtggcctctcgggctcggcagaagggacgccggatcaggggcctggtctccagcacctgcccgagtggccgtggccaggatggggtgcgcattccgtgtgctttgcttgtagctgtgcaggctgaggtctggagccaggcccagagctggcttcagggtggggccttgagaaggggaatgtgggacaggggcgatggtgcctggtctctgagtaagatgccaggtcccaggaactcaggcttcaggtgagaaggagcggtgtgtccaggcaccgctggccggcagccctgggctgaggcacagactcatttgtcaccttctggcggcggcagccctggccccggcctccaagcagttgaaaaagctggcgcctccttggtctctaggatccaggctccacagagcacatgactagccaggcccctggcttaagaaggtcgcctaagcctaagagaagacagtcccaggagaagctggccgggaccagccaggagctgggagccacaggaagcaaaagtcagccttttcttcaagggatttccctgtctcagagcagcctttgccccagggaaatgggctctgggctggctgcctgcaccggccatgtcgacccaggacccggacacctggtcttgggctgtgttcagccactttgccttctctggactcagtttccccgtctgagaaatgagagtcgaatgctacagtatctgcagtcgcttggatctggctgttgagttgacgggttccttgaaccccacaaaatccctctccaaccacaggacccttcggctcaccaagaacggggcccaggggagtcaggcctattcgctgcacttcctgccaaactttgcccccacaagcctggtcatcagccaggcagccctcccagtgcccaagggccaccaaccccagggaaacagggccagcacagaggggccttcctcccccacagagctcccatgacatagtctgctctgggcggaagagctttgctgccagccagggatgtccagaggtcggtgcagcccctatccctgctcaggagtgggctcagagtctagcaaatgctaaggcccctcaggctgggctctgaacgaggacctggactcagagccagacagggcagcctcagacccttctctggggctcctggaccttgggccataatttctgagcctcggtttccccatctaaggaacagatgtggtcgttccgccctctcagctggatgagactgtcctggaggatccaccccggaacagacagaacggtgtctctcaggatggtgctctgagagagggcagagtggatgccccactgccctagaccctcggtagacgtggggtctctggggcggggtctgtggctgtgactgaagtcggctttcccgttgatgtcttgatgctcctatctgtgcacttaccgtaggtagggacacgtgtccatgcaccacagacacacccacgacacctgatctcgtatcactagcttgcggccaggtcatgatgtggccccggaagctggccctgcgtgccatgagtgcgtcggtcatggagtccggagcccctgagccggcccctggtgacggcacagccctcacagctcaaacgcccacccccactcccaccatctgcaggtggtgaaaacaaaccccgtgtatctctcaataaaggtggccgaagggcctcgatgtgg

SEQ ID NO: 521 - DNA, 2589 bp, Homo sapiens
cgcccgcagagccgccccaggtgcctgggtgttgtgtgattgacgcggggaaggaggggtcagccgatccctccccaaccctccatcccatccctgaggattgggctggtacccgcgtctctcggacagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 522 - DNA, 2590 bp, Homo sapiens
gccttatatagggcgacttggggcacgcagtagctctctcgagtcactccggcgcagtgttgggactgtctgggtatcggaaagcaagcctacgttgctcactattacgtataatccttttcttttcaagatgcctgaggaagtgcaccatggagaggaggaggtggagacttttgcctttcaggcagaaattgcccaactcatgtccctcatcatcaataccttctattccaacaaggagattttccttcgggagttgatctctaatgcttctgatgccttggacaagattcgctatgagagcctgacagacccttcgaagttggacagtggtaaagagctgaaaattgacatcatccccaaccctcaggaacgtaccctgactttggtagacacaggcattggcatgaccaaagctgatctcataaataatttgggaaccattgccaagtctggtactaaagcattcatggaggctcttcaggctggtgcagacatctccatgattgggcagtttggtgttggcttttattctgcctacttggtggcagagaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagtgaagaagcattctcagttcataggctatcccatcaccctttatttggagaaggaacgagagaaggaaattagtgatgatgaggcagaggaagagaaaggtgagaaagaagaggaagataaagatgatgaagaaaaacccaagatcgaagatgtgggttcagatgaggaggatgacagcggtaaggataagaagaagaaaactaagaagatcaaagagaaatacattgatcaggaagaactaaacaagaccaagcctatttggaccagaaaccctgatgacatcacccaagaggagtatggagaattctacaagagcctcactaatgactgggaagaccacttggcagtcaagcacttttctgtagaaggtcagttggaattcagggcattgctatttattcctcgtcgggctccctttgacctttttgagaacaagaagaaaaagaacaacatcaaactctatgtccgccgtgtgttcatcatggacagctgtgatgagttgataccagagtatctcaattttatccgtggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagaattacaagaaattctatgaggcattctctaaaaatctcaagcttggaatccacgaagactccactaaccgccgccgcctgtctgagctgctgcgctatcatacctcccagtctggagatgagatgacatctctgtcagagtatgtttctcgcatgaaggagacacagaagtccatctattacatcactggtgagagcaaagagcaggtggccaactcagcttttgtggagcgagtgcggaaacggggcttcgaggtggtatatatgaccgagcccattgacgagtactgtgtgcagcagctcaaggaatttgatgggaagagcctggtctcagttaccaaggagggtctggagctgcctgaggatgaggaggagaagaagaagatggaagagagcaaggcaaagtttgagaacctctgcaagctcatgaaagaaatcttagataagaaggttgagaaggtgacaatctccaatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaataaagaatatgccgtttttataca

SEQ ID NO: 523 - DNA, 3356 bp, Homo sapiens
aggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacatgtaggcacagaaaacaggaatgcagacaacatgcatcccctgcgtccatgagttacatgtgttctcttagtgtccacgttgttttgatgttattcatggaataccttctgtgctaaatacagtcacttaattccttggcctt

SEQ ID NO: 524 - DNA, 3635 bp, Homo sapiens
ggcttgtttacggcccgactgcgcaggcgtgctcacctggcgtgctccacccgactgggcgtccgcaggctcctcccccgggtgtggcctccgggcggcatggctgcttcccaggtgatgccggcttcagctagtggggtctagttgaccgttccgcagccgccagggccagcggaaagccggtcagggggaaccgcggcggggctggtgtcatgagcctgaggtgaacttgagggtgcctcctcagcggtctcccgccctgccctgaggggcgccgggaccccaaagagcggaggaagagcgccaccccgacggccaccgcttcggagccagcacgcggggtaccctacggggagcgcggatgcccccgtgttcgggcggggacggctccacccctcctgggccctcccttcgggacagggactgtcccgcccagagtgctgaatacccgcgcgaccgtctggatccccgcccaggaagcccctctgaagcctcctcgccgccgtttctgagaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacatgtaggcacagaaaacaggaatgcagacaacatgcatcccctgcgtccatgagttacatgtgttctcttagtgtccacgttgttttgatgttattcatggaataccttctgtgctaaatacagtcacttaattccttggcc

SEQ ID NO: 525 - DNA, 5484 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcagggcttaagggcatctatcgatgcctatgacaactttgacaacatcagcctggctcagcagctggagaagcatcagctgatggagttcaggtgcattgcggcctatctgtacaagggcaataactggtgggcccagagcgtggagctctgcaagaaggatcatctctacaaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaa

SEQ ID NO: 526 - DNA, 5313 bp, Homo sapiens
attcctgccgctgccgccgccgccgccgaggtcccgcaccagccatggcgcagatcctccctgttcgctttcaggagcacttccagctccaaaaccttggaattaatccagctaacattggattcagcacactgaccatggaatctgacaagttcatatgtatccgagagaaagttggtgagcaggcacaggtcacgatcattgacatgagtgacccaatggctccgatccgacggcctatctctgcagagagtgccatcatgaatccagcctctaaggtgatagctctgaaagctgggaagacacttcagatctttaatattgagatgaagagtaaaatgaaggctcatactatggcagaagaagtgattttctggaaatgggtttctgtgaacactgttgccttggtgaccgagaccgcggtctaccactggagcatggaaggtgactcccagcccatgaagatgtttgatagacataccagtctggtgggctgccaggtgattcactaccggactgatgagtaccagaagtggctgctgctcgtaggcatctcggctcagcaaaaccgtgtggttggagcaatgcagctctactctgtggataggaaggtttcacaacccatagaaggccatgctgcggcttttgcagagttcaagatggaggggaatgccaagcctgccacccttttctgctttgctgtacgtaatcccacaggaggcaagttgcacatcattgaagttggacagcctgcagcgggaaaccaaccttttgtaaagaaagcagtagatgtgttttttcctccagaggcacagaatgattttccagtggctatgcagattggagctaaacatggtgttatttacttgatcacaaagtatggctatcttcatctgtacgacctagagtctggcgtgtgcatctgcatgaaccgtattagtgctgacacaatatttgtcactgctccacacaaaccaacctctggaattattggtgtcaacaaaaagggacaggtactgtcagtttgtgttgaggaagataacattgtgaattatgcaaccaacgtgcttcagaatccagaccttggtctgcgtttggccgttcgtagtaacctggctggggcagagaagttgtttgtgagaaaattcaataccctctttgcacagggcagctatgctgaagccgccaaagttgcagcgtctgcaccaaagggaatcctgcgtaccagagagacggtccagaaattccagagtatacccgctcagtctggccaggcttctccattgctgcagtacttcggaatcctgctcgaccagggtcagctcaataaacttgaatccttagaactttgccatctggttcttcagcaggggcgtaagcaactcctagagaagtggctgaaagaagataagctggagtgctcagaggagctcggagacttggtcaaaaccactgaccccatgctcgctctgagtgtgtaccttcgggcaaatgtgccaagcaaagtgatccagtgttttgcagaaacaggccaattccagaaaattgtgctctatgccaaaaaggttgggtacaccccagactggatctttctgctgaggggtgtaatgaagatcagtccggaacagggcctgcagttttctcgaatgctagtgcaggacgaggagccgctggccaacattagccagattgtggacattttcatggaaaacagtttaattcagcagtgtacttccttcttattggatgccttgaagaataatcgcccagctgagggactcctgcagacatggctgttggagatgaaccttgttcatgcaccccaggttgcagatgccatccttggaaataaaatgtttactcattacgaccgggcccacattgcccagctctgtgagaaggcaggcctcctgcagcaagcactggagcactacaccgacctctatgacatcaagagggctgtggtccacactcacctcctcaatcccgagtggcttgtcaatttctttggctccttatcggtggaggattctgtggagtgtctgcatgccatgctgtctgctaacatcagacagaaccttcagctgtgtgtgcaggtggcctctaagtaccacgagcagctgggcacgcaggccctggtggagctctttgaatccttcaagagttacaaaggcctcttctacttcctgggctcaatcgtgaacttcagccaagacccagatgtgcatctgaaatacattcaggctgcctgtaagacagggcagatcaaggaggtggagaggatatgccgagagagcagctgctacaacccagagcgtgtgaagaacttcctgaaggaggccaagctcacagaccagcttcccctcatcatcgtgtgtgatcgttttggctttgtccatgaccttgtcctatatttataccgcaacaacctgcagaggtacattgagatctacgtgcagaaggtcaaccctagccggaccccagctgtgattggagggctgcttgatgtggattgttctgaggaagtgattaaacacttaatcatggcagtgagaggacagttctctactgatgagttggtggctgaagtagaaaaaagaaataggctcaagctgctgcttccctggctggagtcccagattcaggaaggctgtgaggagcctgccactcacaatgcactggctaaaatctacatcgacagcaacaacagccccgagtgcttcctgagagagaatgcctactatgacagcagcgtggtgggccgctactgtgagaagcgagacccccatctggcctgtgttgcctatgagcgggggcagtgtgaccttgagctcatcaaggtgtgcaatgagaattctctgttcaaaagcgaggcccgctacctggtatgcagaaaggatccggagctctgggctcacgtccttgaggagaccaacccatccaggagacagctaattgaccaggtggtacagacagcattgtcagaaacacgggatcctgaagagatttcggtcactgtcaaagcctttatgacagccgacctgcctaatgaactgattgaactgctggagaagatagttctggataactctgtcttcagcgagcacaggaatctacagaatctgttgatcctgactgccatcaaggcagaccgcacacgggtcatggagtacatcagccgcctggacaactatgacgcactggacatcgcgagcatcgctgtcagcagcgcactgtatgaggaggccttcaccgttttccacaagtttgatatgaatgcctcagcaatccaggtcctgatcgagcacattggaaacctggaccgggcatatgagtttgcggagagatgcaatgagcctgctgtgtggagtcagctggcccaagcccagctccagaaagatttggtgaaggaagccatcaactcctatatcagaggggacgacccttcctcttacctggaagttgttcagtcagccagcaggagcaacaactgggaggatctagttaaatttctgcagatggccaggaaaaagggccgtgagtcctatatagagactgaacttatttttgccttggctaaaaccagccgtgtttctgagctagaagattttattaatggacccaacaatgcccacatccagcaggttggagaccgctgttacgaggagggaatgtacgaggctgccaagctgctctatagcaatgtttctaactttgcccgcctggcttccaccttggttcacctcggtgagtatcaggcagcagtggacaacagccgcaaggccagcagcacccggacgtggaaggaggtgtgctttgcctgcatggatggacaagagttccgcttcgcacagctgtgtggtcttcacatcgtcattcatgcagatgagctggaggagctgatgtgctattaccaggatcgtggctactttgaggagctgatcttgctgttggaagcggccctgggcctggagcgggcccacatgggcatgttcactgagctggccatcctctactccaaattcaagccacagaagatgctggagcatctggagcttttctggtcccgtgtcaacatcccaaaggtgctgagggctgcagagcaggcacacctgtgggctgagctggtgttcctctatgacaagtacgaggagtatgacaatgctgtgctcaccatgatgagccaccccactgaggcctggaaggagggtcagttcaaggacatcattaccaaggttgccaacgtcgagctctgttacagagccctgcagttctatttggattacaaaccactgctcatcaatgacctgctgctggtgctttcaccccggctggaccacacctggacagtcagtttcttttcaaaggcaggtcagctgcccctggtgaagccttacctgcggtcagtccagagccacaacaacaagagtgtgaatgaggcactcaaccacctgctgacagaggaggaggactatcaggatgccatgcagcatgctgcagagtcgcgggatgctgagctggcccagaagttgctgcagtggttcctggaggaaggcaagagggagtgcttcgcagcttgtctcttcacctgctatgacctgcttcgcccagacatggtgcttgagctggcctggaggcacaacctcgtggacttggccatgccctacttcatccaggtgatgagggagtacctgagcaaggtggacaaactggatgccttggagagtctgcgcaagcaagaggagcatgtgacagagcctgcccctctcgtgtttgattttgatgggcatgaatgagacccagctgattgcactaagccctgccgtgggcccagcccctgccagcttcccctatggatatgcctctgctcccaacttcgccagcctccaatgtacaacttccgcgtgtagtgggcgttgtcaccacccaccctacctgcagagttactaacttctccaaggagcatgtcactccagcagcacaggggacgcaatgggaggcagggacacctggacaatatttatttttgctgaaacccaatgacggcaacctctgagccatcccagagcctggggaggccagggtagaggctgacggcgcaagaccagctttagccgacaacagagactggactgtgggccctcctgctggagccaggccttcctcctgggcgcctccgactggctggagctgccccctccaggccagtttgaagactacatgaacacgtcttgtttggaggtaccggacctcataaaaggactctcagcctcttggcaatcataaatattaaagtcggtttatccaggcaaa

SEQ ID NO: 527 - DNA, 7787 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgaaaagaacagtagtttttgtagttttatattggatactgaggcattagggaggcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggtttttatcgaagcatttcacttaaatgaacaaatcatggctgttatattaacttgaaataaaatatatttaaacatgtagttaacatgctctttctcatcatgaattataaaggtgcccaaattatgggtatcttgatttttttcaaaaattggttgtgtgaatccagctcttgcttatggctgagaatgttcctaaagttcatttcactatcccttaatcctcaatagctacacatacccccttgcctagttagtcttgcactgctttacaactctcttaggcaaattacctaacataagctccacagaagagttttttaaaacttaaaatccctgtcccaccaggtgtggtggctcatgcctgtaatcccagcactttgggaggctgaggcaggcggattgcttgaggccaggagttcgagacaagcctgaccaacatggtgactccatctctactaaaaataaaaaatcagccaggtgtgatggtggatgcctataagatcctagctgctactcaggaggcaggaggctgaggcatgagaatcacttgaacctgtgaggcaaaggttgtagtgagccaagatcacgtcactgcactccatcctgggtgacagaatgagactcttgtctcaaaaaacaaaaaaacctatttagtttcatccaggacattaagtgaaagtgtttaatgtgagtgcaggtcagtgaagaatacaatggtgcccctgctttgatttgtgggaggtgccatcagttttccccaccactgcttttgcaccctcagtgcaaatatcaacacagagaaaaaaaaaaataatagtattatgaaaacattgactctgtggagaccctgtgggttctgcagagtatactttgaaaactataagattatgagttctataaaataccaagtacagatgaactagaaaacaagcatatatccacaattaccagaattttcatagtattccttttagtagatatgccatgacagttacttagccaccccatgccatcctgttgggaatgccactacctttgaatttggagccatcagtctatctgaggcaaacctcagaaattacctgagccagaatcatgcacttagcactgagttcaactcagtcttaacgttgcattttgttgcatcacttttgcagccagtaaacattctgtttagaaatagttgctattgtggcatcattcacagttgcaatttttctcctgtgctgtcatatgcctgtgcgaagtgtattaaatgaatcaaatattagaaatttcaaggctgtctttagtgttctgcccacaatactccaccaatgaccttagaccttgagatggt

SEQ ID NO: 528 - DNA, 6400 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggttttta

SEQ ID NO: 529 - DNA, 6421 bp, Homo sapiens
cagccgtttccggagtctgcgctgcgcccggttccgccattgcggctctcctggcccctggagcctccgcccccgacccgagctctttcgtctgcctgccagtttcctgcgtccccggagaggatcctgctgagcccagcctcccccctccccttctcctcctctcccttggagagcccgggcagccactgccccgcagccccagtgacaggaggagaccataacccccgacagcgccatggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggttgatgcaataaaggaaaaggtggataaattagatgcttcagaatcactgagaaaagaagaagaacaagctacagagacacaacccattgtttatggtcagccccagttgatgctgacagcaggacccagtgttgccgtccctccccaggcaccttttggttatggttataccgcaccaccgtatggacagccacagcctggctttgggtacagcatgtgagatgaagcgctgatcctgtagtcacctattttcgtactgaaacatcgtctttacccacttctcagtttataatgggggaaaacaggcaacgtgttcttgtaacctttatttcatgaaggacttctttttgtttctaactataaacttggatcacctatgttaaaaccttatttcacattccacatcattttagaatttattttcgaaggggaatagtttcaatgttttattcacttgggctttttttcttccccctctttctttaaagaactgctcaatattcaatctgttgtgaagaacctgatttgcactctgtagtgtttaaagaaacaaagaaactctaatattgaatctcttaaatttagtgtatgtaaacagcttacaaatacgtattgtctaaatgcatttaaatctgttttattcaaagaaaagctaaagcaaaaacactggcatatgaccatgcaagactgtcagtgccaacaaagacaacactaatcagcacatcgtacactggattgcagtgcttcccagattattgaaaaatgttacagacaacttgcctgatttttaaatgagcgtaaaaggccctctaacctatgcaggtttccccattatgcatatagaaaatgctagtatgttttgctcacttcatatgtaacaggtgcccttatgttgtgctgtatcctgtgctttttctgtgggaccattccattcaggagcaaagagcaccatgattccaatcttgtgtgtgtttactaacccttccctgaggtttgtgtatgttggatattgtggtgttttagatcactgagtgtacagaagagagaaattcaaacaaaatattgctgttcttcagttttgtttgtggaatttgaaattactcaaatttaaaataaattactggactgtggaaataacatagaattgaagttttaattaaataccactcaaacgcatgaaaggaagaggaatgaggattgagacatgtgaagacattgtgcattatatcaatgtgcattcctgtagttcattaacaaggtacatgcaatagtctaaagaaccagagtcactactatagtggcttaacatttaatctgtctccaatattttaaccaagtgacaccgaggttttta

SEQ ID NO: 530 - DNA, 14760 bp, Homo sapiens
ccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggtccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagctgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 531 - DNA, 14321 bp, Homo sapiens
ccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggtccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacaggaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagctgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaat

SEQ ID NO: 532 - DNA, 14641 bp, Homo sapiens
atggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgcgtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggcccggagcctgccccagccacagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggtccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacaggaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagctgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggaggatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaat

SEQ ID NO: 533 - DNA, 276 bp, Homo sapiens
gttctcacaccatccagataatgtatggctgcgacgtggggtcggacgggcgcttcctccgcgggtaccggcaggacgcctacgacggcaaggattacatcgccctgaacgaggacctgcgctcttggaccgcggcggacatggcggctcagatcaccaagcgcaagtgggaggcggcccatgaggcggagcagttgagagcctacctggatgccacgtgcgtggagtggctccgcagatacctggagaacgggaaggagacgctgcagcgcacgg

SEQ ID NO: 534 - DNA, 1826 bp, Homo sapiens
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgaggtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcacctgcatgtgtctgtgttcgtgtaggcataatgtgaggaggtggggagaccaccccacccccatgtccaccatgaccctcttcccacgctgacctgtgctccctccccaatcatctttcctgttccagagaggtggggctgaggtgtctccatctctgtctcaacttcatggtgcactgagctgtaacttcttccttccctattaaaattagaacctgagtataaatttactttctcaaattcttgccatgagaggttgatgagttaattaaaggagaagattcctaaaatttgagagacaaaataaatggaacacatgagaacctt

SEQ ID NO: 535 - DNA, 1567 bp, Homo sapiens
cgcttggcacagaagcagaggggtcagggcgaagtcccagggccccaggcgtggctctcagggtctcaggccccgaaggcggtgtatggattggggagtcccagccttggggattccccaactccgcagtttcttttctccctctcccaacctatgtagggtccttcttcctggatactcacgacgcggacccagttctcactcccattgggtgtcgggtttccagagaagccaatcagtgtcgtcgcggtcgcggttctaaagtccgcacgcacccaccgggactcagattctccccagacgccgaggatggccgtcatggcgccccgaaccctcctcctgctactcttgggggccctggccctgacccagacctgggcgggctcccactccatgaggtatttcaccacatccgtgtcccggcccggccgcggggagccccgcttcatcgccgtgggctacgtggacgacacgcagttcgtgcggtttgacagcgacgccgcgagccagaggatggagccgcgggcaccgtggatagagcaggaggggccggagtattgggacctgcagacacggaatgtgaaggcccagtcacagactgaccgagcgaacctggggaccctgcgcggctactacaaccagagcgaggccggttctcacaccatccagatgatgtatggctgcgacgtggggtcggacgggcgcttcctccgcgggtaccggcaggacgcctacgacggcaaggattacatcgccttgaacgaggacctgcgctcttggaccgcggcggacatggcggctcagatcacccagcgcaagtgggaggcggcccgtgtggcggagcagttgagagcctacctggagggcacgtgcgtggagtggctccgcagatacctggagaacgggaaggagacgctgcagcgcacggacgcccccaaaacgcatatgactcaccacgctgtctctgaccatgaagccaccctgaggtgctgggccctgagcttctaccctgcggagatcacactgacctggcagcgggatggggaggaccagacccaggacacggagctcgtggagaccaggcctgcaggggatggaaccttccagaagtgggcggctgtggtggtgccttctggacaggagcagagatacacctgccatgtgcagcatgagggtttgcccaagcccctcaccctgagatgggagccgtcttcccagcccaccatccccatcgtgggcatcattgctggcctggttctctttggagctgtgatcactggagctgtggtcgctgctgtgaggtggaggaggaagagctcagatagaaaaggagggagctactctcaggctgcaagcagtgacagtgcccagggctctgatgtgtctctcacagcttgtaaagtgtgagacagctgccttgtgtgggactgagaggcaagagttgttcctgcccttccctttgtgacttgaagaaccctgactttgtttctgcaaaggcaccttccaccatgaccctcttcccacgctgacctgtgctccctccccaatcatctttcctgttccagag

SEQ ID NO: 536 - DNA, 1524 bp, Homo sapiens
atgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatatgcagcacgaggggctgccagagcccctcaccctgagctgggagccatcttcccagcccaccatccccatcatgggcatcgttgctggcctggctgtcctggctgtcctagctgtcctaggagctgtgatggctgttgtgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 537 - DNA, 1578 bp, Homo sapiens
ggttctaaagtccccagtcacccacccggactcacattctccccagaggccgagatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatatgcagcacgaggggctgccagagcccctcaccctgagctgggagccatcttcccagcccaccatccccatcatgggcatcgttgctggcctggctgtcctggctgtcctagctgtcctaggagctgtgatggctgttgtgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 538 - DNA, 1591 bp, Homo sapiens
gtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttctacaccgccatgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggagagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttatgtgcactgagctgcaacttcttacttccctactgaaaataagaatctgaatataaatttgttttctcaaatatttgctatgagaggttgatggattaattaaataagtcaattcctggaatttgagagagcaaataaagacctgagaaccttccagaatctgc

SEQ ID NO: 539 - DNA, 1536 bp, Homo sapiens
gtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttctacaccgccatgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggagagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggagccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtgcagcgacagtgcccagggctctgatgtgtctctcacagcttgaaaagcctgagacagctgtcttgtgagggactgagatgcaggatttcttcacgcctcccctttgtgacttcaagagcctctggcatctctttctgcaaaggcacctgaatgtgtctgcgtccctgttagcataatgtgaggaggtggagagacagcccacccttgtgtccactgtgacccctgttcccatgctgacctgtgtttcctccccagtcatctttcttgttccagagaggtggggctggatgtctccatctctgtctcaactttatgtgcactgagctgcaacttcttacttccctaagaggttgatggattaattaaataagtcaattcctggaatttgagagagcaaataaagacctgagaaccttccagaa

SEQ ID NO: 540 - DNA, 2543 bp, Homo sapiens
acgccgagatgcgggtcacggcgccccgaaccctcctcctgctgctctggggggcagtggccctgaccgagacctgggccggtgagtgcgggatcgggagggaaatggcctctgtggggaggagcgaggggaccgcaggcgggggcgcaggacccggggagccgcgccgggaggagggtctggcgggtctcagcccctcctggcccccaggctcccactccatgaggtatttctacaccgccatgtcccggcccggccgcggggagccccgcttcatcaccgtgggctacgtggacgacacccagttcgtgaggttcgacagcgacgccacgagtccgaggatggcgccccgggcgccatggatagagcaggaggggccggagtattgggaccgggagacacagatctccaagaccaacacacagacttaccgagagaacctgcgcaccgcgctccgctactacaaccagagcgaggccgggtctcacatcatccagaggatgtacggctgcgacgtggggccggacgggcgcctcctccgcgggtatgaccaggacgcctacgacggcaaggattacatcgccctgaacgaggacctgagctcctggaccgcggcggacaccgcggctcagatcacccagcgcaagtgggaggcggcccgtgtggcggagcagctgagagcctacctggagggcctgtgcgtggagtggctccgcagatacctggagaacgggaaggagacgctgcagcgcgcgggtaccaggggcagtggggagccttccccatctcctatagacgccgagatgctggtcatggcgccccgaaccgtcctcctgctgctctcggcggccctggccctgaccgagacctgggccgaccccccaaagacacacgtgacccaccaccccatctctgaccatgaggccaccctgaggtgctgggccctgggcttctaccctgcggagatcacactgacctggcagcgggatggcgaggaccaaactcaggacactgagcttatgcgggtcatggcgccccgagccctcctcctgctgctctcgggaggcctggccctgaccgagacctgggcctgctcccactccatgaggtatttcgacaccgccgtgtcccggcccggccgcggagagccccgcttcatctcagtgggctacgtggacgacacgcagttcgtgcggttcgacagcgacgccgcgagtccgagaggggagccgcgggcgccgtgggtggagcaggaggggccggagtattgggaccgggagacacagaagtacaagcgccaggcacaggctgaccgagtgagcctgcggaacctgcgcggctactacaaccagagcgaggacgggtctcacaccctccagaggatgtatggctgcgacctggggcccgacgggcgcctcctccgcgggtatgaccagtccgcctacgacggcaaggattacatcgccctgaacgaggacctgcgctcctggaccgccgcggacacggcggctcagatcacccagcgcaagtgggaggcggcccgtgaggcggagcagtggagagcctacctggagggcacgtgcgtggagtggctccgcagatacctggagaacgggaaggagacgctgcagcgcgcggaacacccaaagacacacgtgacccaccatcccgtctctgaccatgaggccaccctgaggtgctgggccctgggcttctaccctgcggagatcacactgacctggcagcgggatggcgaggaccaaactcaggacaccgagcttgtggagaccaggccagcaggagatggaaccttccagaagtgggcagctgtggtggtgccttctggagaagagcagagatacacgtgccatatgcagcacgaggggctgccagagcccctcaccctgagctgggagccatcttcccagcccaccatccccatcatgggcatcgttgctggcctggctgtcctggctgtcctagctgtcctaggagctgtgatggctgttgtgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 541 - DNA, 1587 bp, Homo sapiens
gtcgccggggtcccagttctaaagtccccacgcacccacccggactcagagtctcctcagacgccgagatgctggtcatggcgccccgaaccgtcctcctgctgctctcggcggccctggccctgaccgagacctgggccggctcccactccatgaggtatttctacaccgccatgtcccggcccggccgcggggagccccgcttcatctcagtgggctacgtggacgacacccagttcgtgaggttcgacagcgacgccgcgagtccgagagaggagccgcgggcgccgtggatagagcaggaggggccggagtattgggaccggaacacacagatcttcaagaccaacacacagactgaccgagagagcctgcggaacctgcgcggctactacaaccagagcgaggccgggtctcacaccctccagagcatgtacggctgcgacgtggggccggacgggcgcctcctccgcgggcataaccagtacgcctacgacggcaaggattacatcgccctgaacgaggacctgcgctcctggaccgcggcggacaccgcggctcagatcacccagcgcaagtgggaggcggcccgtgtggcggagcaggagagagcctacctggagggcacgtgcgtggagtggctccgcagatacctggagaacgggaaggacacgctggagcgcgcggaccccccaaagacacacgtgacccaccaccccatctctgaccatgaggccaccctgaggtgctgggccctgggcttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatgggccgtcttcccagtccaccgtccccatcgtgggcattgttgctggcctggctgtcctagcagttgtggtcatcggagctgtggtcgctgctgtgatgtgtaggaggaagagctcaggtggaaaaggagggagctgctctcaggctgcgtgcagcaacagtgcccagggctctgatgagtctctcatcacttgtaaagcctgagacagctgcctgtgtgggactgagatgcaggatttcttcacacctctcctttgtgacttcaagagcctctggcatctctttctgcaaaggcatctgaatgtgtctgcgttcctgttagcataatgtgaggaggtggagagacagcccacccccgtgtccaccgtgacccctgtccccacactgacctgtgttccctccccgatcatctttcctgttccagagaagtgggctggatgtctccatctctgtctcaactttacgtgtactgagctgcaacttcttacttccctactgaaaataagaatctgaatataaatttgttttctcaaatatttgctatgagaggttgatggattaattaaataagtcaattcctggaagttgagagagcaaataaagacctgagaaccttccagaatccgc

SEQ ID NO: 542 - DNA, 1089 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccgggagacacagatctccaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagctcaggtggaaaaggagggagctactctcaggctgcgtccagcgacagtgcccagggctctgatgtgtctctcacagcttga

SEQ ID NO: 543 - DNA, 1089 bp, Homo sapiens
atgctggtcatggcgccccgaaccgtcctcctgctgctctcggcggccctggccctgaccgagacctgggccggctcccactccatgaggtatttctacacctccgtgtcccggcccggccgcggggagccccgcttcatctcagtgggctacgtggacgacacgcagttcgtgaggttcgacagcgacgccgcgagtccgagagaggagccgcgggcgccgtggatagagcaggaggggccggaatattgggaccggaacacacagatctgcaagaccaacacacagactgaccgagagagcctgcggaacctgcgcggctactacaaccagagcgaggccgggtctcacaccctccagaggatgtacggctgcgacgtggggccggacgggcgcctcctccgcgggcataaccagttcgcctacgacggcaaggattacatcgccctgaacgaggacctgagctcctggaccgcggcggacaccgcggctcagatcacccagcgcaagtgggaggcggcccgtgtggcggagcagctgagaacctacctggagggcacgtgcgtggagtggctccgcagatacctggagaacgggaaggagacgctgcagcgcgcggaccccccaaagacacatgtgacccaccaccccatctctgaccatgaggccaccctgaggtgctgggccctgggcttctaccctgcggagatcacactgacctggcagcgggatggcgaggaccaaactcaggacaccgagcttgtggagaccagaccagcaggagacagaaccttccagaagtgggcagctgtggtggtgccttctggagaagagcagagatacacatgccatgtacagcatgaggggctgccgaagcccctcaccctgagatgggagccatcttcccagtccaccgtccccatcgtgggcattgttgctggcctggctgtcctagcagttgtggtcatcggagctgtggtcgctgctgtgatgtgtaggaggaagagttcaggtggaaaaggagggagctactctcaggctgcgtccagcgacagtgcccagggctctgatgtgtctctcacagcttga

SEQ ID NO: 544 - DNA, 2437 bp, Homo sapiens
cacgcggcaggcggtggcgggattctgccgcgtgcgctttcccgccccgcctcgcctagcctcgtcctgcgctcgccacgcctcgggctgtccgttgggccacgcagaccgcgctgcgctcgctccgtcgcggctccgcgtgccccaccttctggctagttttttctagagcccaggctccgcccgtttcccgcttccagggcccggttcgttcccgcccgcacccgtccctctcctctgcacccctgctgcttctgctttgaaggcggaggctccatgttgtcccctcagcgagtggcagcagctgcctcaagaggagcagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcaggcttcttctcatatcggtaattccactcaggccactgtgagggatgcagttgttggaagaccatccatggataaaaaagctcaatagcatcttaacgtgaagatcaaacaagaacacaacaagcccctactgatttctgggtttctgccacggccacaggttcatatccagaggaatggcagatctgagacgatccaggaagagctaaaacatggccctgtaataaatgagcagacctctcctgtggtttcaaattattaaacacacttccatttctcttggaagcatttcttttccttgctgttatagatgcaagcctgtgtctattttcatattactctgctttgtgcactttatggaggaggaagctagaggaaaaatggaaatgcagcttttaagttctttatgtgccacttagtgccttttaagattgattccatggttttgcacacacgatggggaggggatggaggataacctcatgaaaggtgccgttttcgggtgaaacttgacatttcttttatactttactcttttgagaaggattctttttttttttttttttttttttgagttggagtctcgctctgtcaccaggcttgagtgcagtggtgtgatcttg

SEQ ID NO: 545 - DNA, 1777 bp, Homo sapiens
aggcctagttaaacaccaaagctgtctctcacactggtggttccaggataaagcctcggcctggggcctggtctgcacgttaggcgccggccgcagctcgcaggaggacccgagccagcccgccccttcccgcacagcctgctgggagttgtagttcagtcgtcggagaaccacgccaagccccgccccagatgagtgcgcagtatgaggaccgctggccgggacccagtgagcgcgggactacaattcccaaaggacggtagcactcagcgccccgccaacagatgatgccatggagagcagcaagcctggtccagtgcaggttgttttggttcagaaagatcaacattcctttgagctagatgagaaagccttggccagcatcctcttgcaggaccacatccgagatcttgatgtggtggtggtttcagtggctggtgccttccgaaagggcaagtccttcattctggattttatgctacgatacttatattctcagaaggaaagtggccattcaaattggttgggtgacccagaagaaccgttaacaggattttcctggagagggggatctgatccagaaaccactgggattcaaatctggagtgaagttttcactgtggagaagccaggtgggaagaaggttgcagttgttctgatggatacccagggggcatttgacagccagtcaactgtgaaagactgtgctaccatctttgctctaagcactatgactagttctgttcagatttataatttatctcagaacattcaagaagatgatcttcaacagctgcagctcttcacagaatacggtcgtctggcaatggatgaaattttccaaaagcctttccagacactgatgtttttggttagagattggagtttcccttatgaatatagctatggactccaaggaggaatggcatttttggataagcgtttacaggtgaaggaacatcaacatgaagaaattcagaatgttcgaaatcacattcactcatgtttctccgatgtcacctgctttctcttaccacatccaggactccaggtggccacaagccctgactttgatgggaaattaaaagatattgctggtgaattcaaagagcagttacaggcactgataccgtatgtattaaacccatctaagttaatggaaaaggagatcaatggctcaaaggtcacctgtcggggactactggagtattttaaggcatatattaaaatttatcaaggagaagatctgcctcaccccaagtccatgcttcaggccactgctgaagccaacaacttagcagctgcagcctctgccaaggacatttattataacaacatggaagaggtttgtgggggagagaaaccttatttgtctccagacattctagaggagaagcactgtgaattcaaacaacttgctctggaccattttaagaagaccaagaagatgggtgggaaggatttcagctttcgttaccagcaggagctggaggaggaaatcaaggaattatatgagaacttctgcaagcacaatggtagcaagaacgtcttcagcaccttccgaacccctgcagtgctgttcacgggcattgtagctttgtacatagcctcaggcctcactggcttcataggtcttgaggttgtagcccagttgttcaactgtatggttggactactgttaatagcactcctcacctggggctacatcaggtattctggtcaatatcgtgagctgggcggagctattgattttggtgccgcatatgtgttggagcag

SEQ ID NO: 546 - DNA, 3442 bp, Homo sapiens
gagaagactggagaaagaatagagggctgagaccagaggtgaagcgggagggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 547 - DNA, 3391 bp, Homo sapiens
gacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 548 - DNA, 3558 bp, Homo sapiens
ccgccgcagcctctgtgcggtgggaccaacggacggacggacggacgcgcgcacctaccgaggcgcgggcgctgcagaggctcccagcccaagcctgagcctgagcccgccccgaggtccccgccccgcccgcctggctctctcgccgcggagccgccaagatgggggacaagaaagatgacaaggactcacccaagaagaacaagggcaaggagcgccgggacctggatgacctcaagaaggaggtggctatgacagagcacaagatgtcagtggaagaggtctgccggaaatacaacacagactgtgtgcagggtttgacccacagcaaagcccaggagatcctggcccgggatgggcctaacgcactcacgccaccgcctaccaccccagagtgggtcaagttttgccggcagctcttcgggggcttctccatcctgctgtggatcggggctatcctctgcttcctggcctacggtatccaggcgggcaccgaggacgacccctctggtgacaacctgtacctgggcatcgtgctggcggccgtggtgatcatcactggctgcttctcctactaccaggaggccaagagctccaagatcatggagtccttcaagaacatggtgccccagcaagccctggtgatccgggaaggtgagaagatgcaggtgaacgctgaggaggtggtggtcggggacctggtggagatcaagggtggagaccgagtgccagctgacctgcggatcatctcagcccacggctgcaaggtggacaactcctccctgactggcgaatccgagccccagactcgctctcccgactgcacgcacgacaaccccttggagactcggaacatcaccttcttttccaccaactgtgtggaaggcacggctcggggcgtggtggtggccacgggcgaccgcactgtcatgggccgtatcgccaccctggcatcagggctggaggtgggcaagacgcccatcgccatcgagattgagcacttcatccagctcatcaccggcgtggctgtcttcctgggtgtctccttcttcatcctctccctcattctcggatacacctggcttgaggctgtcatcttcctcatcggcatcatcgtggccaatgtcccagagggtctgctggccactgtcactgtgtgtctgacgctgaccgccaagcgcatggcccggaagaactgcctggtgaagaacctggaggctgtagaaaccctgggctccacgtccaccatctgctcagataagacagggaccctcactcagaaccgcatgacagtcgcccacatgtggtttgacaaccagatccacgaggctgacaccactgaggaccagtcagggacctcatttgacaagagttcgcacacctgggtggccctgtctcacatcgctgggctctgcaatcgcgctgtcttcaagggtggtcaggacaacatccctgtgctcaagagggatgtggctggggatgcgtctgagtctgccctgctcaagtgcatcgagctgtcctctggctccgtgaagctgatgcgtgaacgcaacaagaaagtggctgagattcccttcaattccaccaacaaataccagctctccatccatgagaccgaggaccccaacgacaaccgatacctgctggtgatgaagggtgcccccgagcgcatcctggaccgctgctccaccatcctgctacagggcaaggagcagcctctggacgaggaaatgaaggaggccttccagaatgcctaccttgagctcggtggcctgggcgagcgcgtgcttggtttctgccattattacctgcccgaggagcagttccccaagggctttgccttcgactgtgatgacgtgaacttcaccacggacaacctctgctttgtgggcctcatgtccatgatcgacccaccccgggcagccgtccctgacgcggtgggcaagtgtcgcagcgcaggcatcaaggtcatcatggtcaccggcgatcaccccatcacggccaaggccattgccaagggtgtgggcatcatctctgagggcaacgagactgtggaggacatcgccgcccggctcaacattcccgtcagccaggttaacccccgggatgccaaggcctgcgtgatccacggcaccgacctcaaggacttcacctccgagcaaatcgacgagatcctgcagaatcacaccgagatcgtcttcgcccgcacatccccccagcagaagctcatcattgtggagggctgtcagagacagggtgcaattgtggctgtgaccggggatggtgtgaacgactcccccgctctgaagaaggccgacattggggtggccatgggcatcgctggctctgacgtctccaagcaggcagctgacatgatcctgctggacgacaactttgcctccatcgtcacaggggtggaggagggccgcctgatcttcgacaacctaaagaagtccattgcctacaccctgaccagcaatatcccggagatcacgcccttcctgctgttcatcatggccaacatcccgctgcccctgggcaccatcaccatcctctgcatcgatctgggcactgacatggtccctgccatctcactggcgtacgaggctgccgaaagcgacatcatgaagagacagcccaggaacccgcggacggacaaattggtcaatgagagactcatcagcatggcctacgggcagattggaatgatccaggctctcggtggcttcttctcttactttgtgatcctggcagaaaatggcttcttgcccggcaacctggtgggcatccggctgaactgggatgaccgcaccgtcaatgacctggaagacagttacgggcagcagtggacatacgagcagaggaaggtggtggagttcacctgccacacggccttctttgtgagcatcgttgtcgtccagtgggccgatctgatcatctgcaagacccggaggaactcggtcttccagcagggcatgaagaacaagatcctgatcttcgggctgtttgaggagacggccctggctgccttcctgtcctactgccccggcatggacgtggccctgcgcatgtaccctctcaagcccagctggtggttctgtgccttcccctacagtttcctcatcttcgtctacgacgaaatccgcaaactcatcctgcgcaggaacccagggggttgggtggagaaggaaacctactactgacctcagccccaccacatcgcccatctcttccccgtcccgcaggcccaggaccgcccctgtcagtccccccaattttgtattctggggggaggagccctctcttcctgtggccccaccttggcccccaccccctccactatctcctgccgcccccactctggctggcttctctcccctgccccaaacctctctcctctctcttttctgtgtcagtttctctccctctcctcacccctctatccattcctcccgccccagccacctccctgggctcttttttactccccttcagccccccggctgatgccatctctggttctggacaattatcaaatatatcagtggggagagagaa

SEQ ID NO: 549 - DNA, 1816 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggccatttgcttcgctccgccccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggtaagtttgctgtggggctctgctttatttagcctagtgaatcttaggatttttcatcggccttcagtcactaactccatgtctttattctttgcagctgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaat

SEQ ID NO: 550 - DNA, 815 bp, Homo sapiens
aaggacttcctggcaggtggagtggccgcagccatctccaagacggcggtagcgcccatcgagcgggtcaagctgctgctgcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaattttgtctgcagtatattttcat

SEQ ID NO: 551 - DNA, 1886 bp, Homo sapiens
tgatttttcatgtactattttaaaaaaatcagaagcaatgcaaaaatccatgatgaacaaatgatcaacatttgaaatacagacaggatcccaacctgcacttgcatgaccttgtctcgcttgcctcaccctaaacccagccttgacactccaattaaactttatttacaaaacaagggggccggccagtaggatgtagtttgcccatacgacttttttaaagtatcgcattgactactgtttatctcgatgactgaagggttcttttggcatccctgtagcaaatgcgtctcaccctagtcctggtcctgctccaagggtttttgtccaggcacatcgtgacctcacccttcctcccctctccgaggcctctctcagggtccagcgttcaagtcccgggtgttctctggacccgccccttcctctcgccgggtcaggtgccgagggcgagcacgggcggcgcggagagcagtcccggcccgccctccacgactcctcctcctgcgagctgggccactcagcggctctgccgcccagcgcgccggggcccagaccccgccccggccccgcctccgacgcctgccgctccagctccggctccccctatataaatcggccatttgcttcgctccgccccgcagcgccggagtcaaagccggttcccggcccagtcccgtcctgcagcagtctgcctcctctttcaacatgacagatgccgctgtgtccttcgccaaggacttcctggcaggtggagtggccgcagccatctccaagacggcggtagcgcccatcgagcgggtcaagctgctgctgcaggtgcagcatgccagcaagcagatcactgcagataagcaatacaaaggcattatagactgcgtggtccgtattcccaaggagcagggagttctgtccttctggcgcggtaacctggccaatgtcatcagatacttccccacccaggctcttaacttcgccttcaaagataaatacaagcagatcttcctgggtggtgtggacaagagaacccagttttggcgctactttgcagggaatctggcatcgggtggtgccgcaggggccacatccctgtgttttgtgtaccctcttgattttgcccgtacccgtctagcagctgatgtgggtaaagctggagctgaaagggaattccgaggcctcggtgactgcctggttaagatctacaaatctgatgggattaagggcctgtaccaaggctttaacgtgtctgtgcagggtattatcatctaccgagccgcctacttcggtatctatgacactgcaaagggaatgcttccggatcccaagaacactcacatcgtcatcagctggatgatcgcacagactgtcactgctgttgccgggttgacttcctatccatttgacaccgttcgccgccgcatgatgatgcagtcagggcgcaaaggaactgacatcatgtacacaggcacgcttgactgctggcggaagattgctcgtgatgaaggaggcaaagcttttttcaagggtgcatggtccaatgttctcagaggcatgggtggtgcttttgtgcttgtcttgtatgatgaaatcaagaagtacacataagttatttcctaggatttttccccctgtgaacaggcatgttgtattatataacatatcttgagcattcttgacagactcctggctgtcagtttctcagtggcaactatttactggttgaaaatgggaagcaataatattcatctgaccagttttctcttaaagccatttccatgatgatgatgatgggactcaattgtattttttatttcagtcactcctgataaataacaaatttggagaaataaaaatatctaaaataaattttgtctgcagtatattttcat

SEQ ID NO: 552 - DNA, 3573 bp, Homo sapiens
ccggtgcagcggctggcgatcggccgcggaggtgcgtgcagggcccgcgccgccgccggtatctccaccgccaacacctcagccactgccactgccacagccacacgaggccccccaccgtgcgctccgccgctgcggtcccggatccgcgctccacgcccgcagcccgcggcgccaccagcccagcatgcaccagctctttcagaaaaccccagaaatttactccgtggagctcagcggaactaaggacatcgtgaaaacagacaagggggatggcaaggagaagtataggggtctgaagaacaactgcctggaactcaaaaagaaaaatcacaaagaggagtttcagaaagaactccatctggatgaccacaaactcagcaatagggaattggaagagaaatatggcacagacatcattatgggtctctccagcaccagagctgccgagctcctggcccgggatgggcccaactccctcacccctcccaagcagacgcctgagatcgtcaagttcctcaagcagatggtgggggggttctctatcctcctgtgggtgggcgcctttctctgttggattgcatatgggattcagtactccagcgacaagtctgcatccctgaacaacgtgtacttgggctgtgtgcttggtctggtggtcattttaacggggatctttgcttattaccaagaggcaaaaagcaccaacatcatgtccagcttcaataagatgatccctcagcaagctctcgtcatccgagattccgagaagaagaccatcccttcagagcagctggtggtgggggacattgtggaggtcaaaggaggagaccagatccctgcagacatcagggtgctgtcttctcaggggtgtcgggtggataactcatctctcacgggggagtctgagccccagccccgctcctctgagtttacccatgaaaaccccctggaaacaaagaacatctgcttctattccacaacgtgtctggaaggcactgtcaccggcatggttatcaacacgggtgaccgcaccatcattggccatattgcctcattggcctcaggagttggaaatgagaagacgcccattgccattgagatcgagcactttgttcacattgtggcaggagtggctgtctccatcggcatccttttcttcatcatcgctgtgtccctgaagtatcaagtcctggactccatcatcttcctcattggcatcattgtggccaatgtgcccgagggcctcctggccactgtcactgtgaccctgtcgctgacagcaaaacggatggccaagaagaactgcctggtgaagaacctggaggctgtggagaccctcggctccacctccatcatctgctcggacaagactgggacactgacccagaacaggatgacagtggcccatctgtggttcgacaatcagatctttgtggctgacaccagtgaggaccattcaaaccaagtctttgaccaaagctctaggacttgggcctccttatccaagataataacattgtgtaaccgagcagagttcaagccaggacaggaaaatgtccccatcatgaagaaagctgtgattggagatgcctcagaaactgctcttttaaaattctcagaggtcattttgggtgatgtgatggaaattagaaaaagaaaccgcaaagtagctgaaatcccttttaactctactaataaatttcagctctccatccacgagatggatgacccccacggcaagcgcttcctcatggtgatgaagggggcccctgagcgcatcctagagaaatgcagcaccatcatgatcaacggcgaggagcacccactggacaagagcactgccaagaccttccacacagcctacatggagctgggcgggttgggcgagcgtgtgctgggtttctgtcatctctacctgccagcagacgagtttccagaaacctactcatttgacatagacgctatgaactttccgacctccaacctctgttttgtgggactcttgtcaatgatcgatccccctcggtccaccgtgccagatgcagtcaccaaatgccggagtgcagggatcaaggttattatggttactggtgatcatcccatcacagccaaagctattgccaagagtgtggggatcatttcagccaacagtgaaacagtggaagacattgcacatcgcctcaacattgctgtggagcaagttaacaaacgggatgccaaggccgctgtggtgactggcatggagctgaaggacatgagctcagaacagctggatgagatcttagccaactaccaggagattgtctttgcccggacatccccccagcagaagctgatcattgtggagggctgtcagaggcaggatgctgttgttgctgtgaccggggatggagttaatgactctccggctctaaagaaggcagacattgggattgccatggggatagcaggttctgatgcagccaaaaatgcagccgacatggtcttgctggacgacaacttcgcatccatcgtcacaggggtggaggaaggtcgcctgatctttgacaacctcaagaagactattgcttattccctgaccaagaacattgccgagctgtgcccctttctgatctacatcattgtcgggctccccctgcccattggcaccatcaccattctgttcattgacttggggacagacattatcccctccattgccttggcgtacgagaaagctgaaagtgacatcatgaacaggaagcctcgccacaagaataaggacaggctggtgaaccagccgctcgctgtgtactcatacctgcacattggcctcatgcaagccctgggagctttccttgtgtatttcaccgtctatgcacaagagggctttctgccccgcactctcattaacctgcgggtagaatgggagaaggactacgtgaatgacttgaaagacagctatgggcaggaatggacaaggtaccagagggaatacctagaatggacgggctacacggctttctttgttggcatcctagtccagcaaatagcagatctgatcatcaggaaaacccggaggaattccatcttccagcagggtctcttcagaaataaagtcatctgggtggggatcacctcacagatcatcattggtctgatcctctcctatggcctcggaagtgtcacagccttgagtttcaccatgcttagggctcagtactggtttgtggctgtgccgcacgccatcctgatctgggtgtatgatgaggtgcggaagctcttcatcaggctctaccctggaagctggtgggataagaacatgtattattaagaccacctcccttcctatgtctctcagcagcacgttggggcacacttgttcatcttctgaccgtttgctgggctattcccctgcagtgcagacatcgtcaaaattcagacaagaggaaattttcatgcagaaagctgtatgcaggatgctcactgatgttttgcactttaaaactgaaattcaactctttatataggattttcttttctatctccatctcctcattaaaaaatacgtacatttcgaggtaatggtat

SEQ ID NO: 553 - DNA, 1597 bp, Homo sapiens
cagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcactttgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaacctcca

SEQ ID NO: 554 - DNA, 1842 bp, Homo sapiens
cagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatgatgcaatctggcactttgccgacaaccagctttttgtttcgggccccaatggcacagccggcatctttgctacctacccctctggacacttggatatgatcaatggcttctttgaccagttcataggcacagcctcccttatcgtgtgtgtgctggccattgttgacccctacaacaaccccgtcccccgaggcctggaggccttcaccgtgggcctggtggtcctggtcattggcacctccatgggcttcaactccggctatgccgtcaaccctgcccgggactttggcccccgcctttttacagcccttgcgggctggggctctgcagtcttcacgaccggccagcattggtggtgggtgcccatcgtgtccccactcctgggctccattgcgggtgtcttcgtgtaccagctgatgatcggctgccacctggagcagcccccaccctccaacgaggaagagaatgtgaagctggcccatgtgaagcacaaggagcagatctgagtgggcaggggccatctccccactccgctgccctggccttgagcatccactgactgtccaagggccactcccaagaagcccccttcacgatccaccctttcaggctaaggagctccctatctaccctcaccccacgagacagccccttcaggatttccactggaccttgcccaaatagcaccttaggccactgcccctaagctggggtggaaccggaatttgggtcaatacatccttttgtctcccaagggaagagaatgggcagcaggtatgtgtgtgtgtgcatgtgtgtgcatgtgtgtgcatgtgtgtgcaggggtgtgtgtgtgtggggggggttcccagatattcagggcaagggaccagtcggaagggattctggctattgggggagcccagagacaggggaaggcagcctgtccatctgtgcataaggagaggaaagttccagggtgtgtatgtttcaggggcttcacatggaggagctgcagatagatatgtgtttctgtgtatgtgtatgtctgcctttttttctaagtgggggcttctacaggcttttgggaagtagggtggatgtgggtagggctgggaggagggggccacagcttaggtttggagctctggatgtacatacataagtaggagcagtgggacgtgtttctgtcataatgcaggcatgaagggtggagtgaagtcaggtcataagtttcatgtttgcttttgttttgttttgtttttaatgtatgtagcagatgttacagtcttagggatccgggatgggagaccccactttagaaagggtcgtcactcctttaatcctctactcaacaatgtactcttttacttttatattaaaaaaaataaaataaatatgtgcctaaaa

SEQ ID NO: 555 - DNA, 633 bp, Homo sapiens
cagcgctggaggccgctgctcgctgcgccaccgcctcccgccacccctgcccgcccgacagcgccgccgcctgccccgccatgggtcgacagaaggagctggtgtcccgctgcggggagatgctccacatccgctaccggctgctccgacaggcgctggccgagtgcctggggaccctcatcctcgtgatgtttggctgtggctccgtggcccaggttgtgctcagccggggcacccacggtggtttcctcaccatcaacctggcctttggctttgctgtcactctgggcatcctcatcgctggccaggtctctggggcccacctgaaccctgccgtgacctttgccatgtgcttcctggctcgtgagccctggatcaagctgcccatctacaccctggcacagacgctgggagccttcttgggtgctggaatagtttttgggctgtattatggtaagcattccccaccctgtcctcctccactacccccgtccctctgttcaggacctgctggcaccaggccttttgatgacagacggctaggacctgcccaggccccgggctcatgactcactcattcacgcacagggtcaaggtagggggcacgaagggaaagaaacaagttgggcaata

SEQ ID NO: 556 - DNA, 4725 bp, Homo sapiens
cagcatcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgacatgacccccgttcccagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 557 - DNA, 4812 bp, Homo sapiens
cagcatcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccggaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 558 - DNA, 3198 bp, Homo sapiens
cagcatcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgagctcccgagtgaggaagggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacgggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgcctgtctttatccaggccttctcaggacagtctcgcaggcctggagtaggcagccgctgaccacctcttggaccccagaccacaccgggttggcctctttgggccagggacacagcatcgtctcgctgtcagagctgctcagagagggaggaagcaggggtgagctc

SEQ ID NO: 559 - DNA, 4706 bp, Homo sapiens
cagcatcctggcgcgggccggggccgccgccgccactgccgtcgggtaaggtcccagcacggacatggcctcgcgcggcgcccgcccgggcccgagtcccccgcgccccgctttgtagccccccggcggagaggcggcctcgacggtgcggacggcgcagacggccgggcgggcggcatggaggcggcgcatctgctcccggccgccgacgtgctgcgccacttctcggtgacagccgagggcggcctgagcccggcgcaggtgaccggcgcgcgggagcgctacggccccaacgggaagtccctgtgggagctggtgctggaacagtttgaggacctcctggtgcgcatcctgctgctggctgcccttgtctcctttgtcctggcctggttcgaggagggcgaggagaccacgaccgccttcgtggagcccctggtcatcatgctgatcctcgtggccaacgccattgtgggcgtgtggcaggaacgcaacgccgagagtgccatcgaggccctgaaggagtatgagcctgagatgggcaaggtgatccgctcggaccgcaagggcgtgcagaggatccgtgcccgggacatcgtcccaggggacattgtagaagtggcagtgggggacaaagtgcctgctgacctccgcctcatcgagatcaagtccaccacgctgcgagtggaccagtccatcctgacgggtgaatctgtgtccgtgaccaagcacacagaggccatcccagaccccagagctgtgaaccaggacaagaagaacatgctgttttctggcaccaatatcacatcgggcaaagcggtgggtgtggccgtggccaccggcctgcacacggagctgggcaagatccggagccagatggcggcagtcgagcccgagcggacgccgctgcagcgcaagctggacgagtttggacggcagctgtcccacgccatctctgtgatctgcgtggccgtgtgggtcatcaacatcggccacttcgccgacccggcccacggtggctcctggctgcgtggcgctgtctactacttcaagatcgccgtggccctggcggtggcggccatccccgagggcctcccggctgtcatcactacatgcctggcactgggcacgcggcgcatggcacgcaagaacgccatcgtgcgaagcctgccgtccgtggagaccctgggctgcacctcagtcatctgctccgacaagacgggcacgctcaccaccaatcagatgtctgtctgccggatgttcgtggtagccgaggccgatgcgggctcctgccttttgcacgagttcaccatctcgggtaccacgtatacccccgagggcgaagtgcggcagggggatcagcctgtgcgctgcggccagttcgacgggctggtggagctggcgaccatctgcgccctgtgcaacgactcggctctggactacaacgaggccaagggtgtgtatgagaaggtgggagaggccacggagacagctctgacttgcctggtggagaagatgaacgtgttcgacaccgacctgcaggctctgtcccgggtggagcgagctggcgcctgtaacacggtcatcaagcagctgatgcggaaggagttcaccctggagttctcccgagaccggaaatccatgtccgtgtactgcacgcccacccgccctcaccctactggccagggcagcaagatgtttgtgaagggggctcctgagagtgtgatcgagcgctgtagctcagtccgcgtggggagccgcacagcacccctgacccccacctccagggagcagatcctggcaaagatccgggattggggctcaggctcagacacgctgcgctgcctggcactggccacccgggacgcgcccccaaggaaggaggacatggagctggacgactgcagcaagtttgtgcagtacgagacggacctgaccttcgtgggctgcgtaggcatgctggacccgccgcgacctgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgacaactttgcctccatcgtggctgcggtggaggagggccgggccatctacagcaacatgaagcaattcatccgctacctcatctcctccaatgttggcgaggtcgtctgcatcttcctcacggcaattctgggcctgcccgaagccctgatccctgtgcagctgctctgggtgaacctggtgacagacggcctacctgccacggctctgggcttcaacccgccagacctggacatcatggagaagctgccccggagcccccgagaagccctcatcagtggctggctcttcttccgatacctggctatcggagtgtacgtaggcctggccacagtggctgccgccacctggtggtttgtgtatgacgccgagggacctcacatcaacttctaccagctgaggaacttcctgaagtgctccgaagacaacccgctctttgccggcatcgactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgtcatcctgctggatgaggccctcaagtacctgtcccggaaccacatgcacgaagaaatgagccagaagtgagcgctgggaacagggtggagtctccggtgtgtacctcagactgatggtgcccatgtgttcgcctccgccccccacccttgccaccacactcgcccacttgcccaccgggtcccgccggataaatgacaggcccgaggtcagaatggccatccccgggccccgtcctggggtctctgtccccacttccttctggcctgggaggtctgtaattcctgtctcctggactctcctgggaagttccctgctctgcagctctggcccaggagctgcaggctgggagggggcagccaagaagccggagctggcagcatacccagagatccggggcccccccacccccaaatcacgagtgcagctggagcttgctcccccttgttcggaagctggacgttcacttggtgactggtgcctctgcactgacggaggactctgggggtccttcttaccggctctgacctctctcttcgtgcctggtctgggactgggtcagccctgggggatcagaaggggccatctgggcccagctgtgtacagcgagggtgggcagccccctccactccactctgcttccacaaagtcggctcccgagagctcgaggctgcttctgtttatatgtgcagggcccgggcgggtgaagggtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttctacccagcccagtgtgcggccgccgcgctgtctgcacagctgggggcctctgagcctggtgggcttcctggactcttggcctcactccttgccccctccccacgacacccatgagccgaaaggatgtcactaaggatggctgattccccaagggcacccgctctccctccctccctgctggaggaacacgtcatatcagatgagaggaagatggcctctgatggacagaatttttctcttaactcagcttttgctactttggcaaaaactagcgaggggtagcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgcttctttcctggggggaggtggggaggtcttagcaggagcgggccctgtacccacctgctgacctgctgtttggtagagaaataaaggttgtgtgactggggg

SEQ ID NO: 560 - DNA, 1783 bp, Homo sapiens
ctccaccaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaagg

SEQ ID NO: 561 - DNA, 1983 bp, Homo sapiens
cgctgtgtgcgtcacgccgacgacgcgcgaagggcacacatcttaggacccggaggacgtccggcctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaagg

SEQ ID NO: 562 - DNA, 2200 bp, Homo sapiens
ctccaccaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctggatttagtgaaatgccgtatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaaaaaaaaaaaaaatatatatatatatatatatatgaagctgatagttgaattatgttgattcagggacaagatagcattgcatagtaacttccagtaggatcaaatattttgagagtggttaaaacgccaaggaatcctgattttatgaaattatgccttctgataggtgcaacaaaattgaacagaagagtaacagcttaactaaacctccattgtgtgaaagttttatgaaatgttttgacttttttttttttttccctagagaacagggttcttgctttgtcgcccaggagtttgaggctgcaatgagctacaatcacacccctgcactccggcctgggcgacagagtgataacctgtctaaaaaaataaaaataaattgtataatcatattgcaattttctttgcattactgatgaggaaaaatctcaaagtaattgtaaaaaatcctggatatcacatagttgagaaacaaagttattttaaacttacaggactctgtagttcacagttgaacactgtggcttcctgaaatatcaaagaataatgtacattaataagccagctactatcggcatcttgtaaaaattaaaaaattaaacataaataaaagttc

SEQ ID NO: 563 - DNA, 1786 bp, Homo sapiens
ctccaccaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaagg

SEQ ID NO: 564 - DNA, 2203 bp, Homo sapiens
ctccaccaatgggcgacgcgtacttgcagtggcgcgctgtgtgcgtcacgccgacgacgcgcgaagggcacacatcttaggacccggaggacgtccggcctctgtgagccgcaacctttccaagggagtggttgtgtgatcgccatcttagggaaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagcagtatagctgtgactatggatctggcagattctttatcctttgtggacttggaggaattattagctgtggcacaacacatacagcattggttcctctagatctggttaaatgcagaatgcaggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaaaaaaaaaaaaaatatatatatatatatatatatgaagctgatagttgaattatgttgattcagggacaagatagcattgcatagtaacttccagtaggatcaaatattttgagagtggttaaaacgccaaggaatcctgattttatgaaattatgccttctgataggtgcaacaaaattgaacagaagagtaacagcttaactaaacctccattgtgtgaaagttttatgaaatgttttgacttttttttttttttccctagagaacagggttcttgctttgtcgcccaggagtttgaggctgcaatgagctacaatcacacccctgcactccggcctgggcgacagagtgataacctgtctaaaaaaataaaaataaattgtataatcatattgcaattttctttgcattactgatgaggaaaaatctcaaagtaattgtaaaaaatcctggatatcacatagttgagaaacaaagttattttaaacttacaggactctgtagttcacagttgaacactgtggcttcctgaaatatcaaagaataatgtacattaataagccagctactatcggcatcttgtaaaaattaaaaaattaaacataaataaaagttc

SEQ ID NO: 565 - DNA, 1960 bp, Homo sapiens
cgctgtgtgcgtcacgccgacgacgcgcgaagggcacacatcttaggacccggaggacgtccggcctctgtgagccgcaacctttccaagggagtggttgtgtgatcgccatcttagggagtgagtgtggccgggccttctcctgtggcgggtgtggggagcggagcccagagctcctgtggggccgctgctttggcggtgggcccagccgggagcagcctctttcgaaggccgccgtgacctcttcaagggcgtggagacgggaaggaaaaggccccggttggggttccagggcgccggtaacgttaaccggcgccttgcctgtcctctaaccgtcgctccctcctcccctagaaagatgttctcgtccgtggcgcacctggcgcgggcgaaccccttcaacacgccacatctgcagctggtgcacgatggtctcggggacctccgcagcagctccccagggcccacgggccagccccgccgccctcgcaacctggcagccgccgccgtggaagagtacagttgtgaatttggctccgcgaagtattatgcactgtgtggctttggtggggtcttaagttgtggtctgacacacactgctgtggttcccctgggtggacccccaaaagtacaagggcatatttaacggattctcagttacacttaaagaggatggtgttcgtggtttggctaaaggatgggctccgactttccttggctactccatgcagggactctgcaagtttggcttttatgaagtctttaaagtcttgtatagcaatatgcttggagaggagaatacttatctctggcgcacatcactatatttggctgcctctgccagtgctgaattctttgctgacattgccctggctcctatggaagctgctaaggttcgaattcaaacccagccaggttatgccaacactttgagggatgcagctcccaaaatgtataaggaagaaggcctaaaagcattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacatagctggagtcttttgtgcaattgtttctcaccctgctgattctgtggtatctgtgttgaataaagaaaaaggtagcagtgcttctctggtcctcaagagacttggatttaaaggtgtatggaagggactgtttgcccgtatcatcatgattggtaccctgactgcactacagtggtttatctatgactccgtgaaggtctacttcagacttcctcgccctcctccacccgagatgccagagtctctgaagaagaagcttgggttaactcagtagttagatcaaagcaaatgtggactgaatctgcttgttgatcagtgttgaagaaagtgcaaaaggaacttttatatatttgacagtgtaggaaattgtctattcctgatataattactgtagtactcttgcttaaggcaagagtttcagatttactgttgaaataaacccaactcttcatgatttgcctgtgacttatttttaaaacttttttaaaaaagatttagctttaaaatagttggaaagaatgaagtatataagttaaggaaaaaatacaaaactgaccatgaccattgttggttgaatattccagttgctattcagaaattgtcatatgtctcaagttttatcacacaaagttcctgtatttctagggaagcagactttaaatttctaaaaacttgatttaattatagttaaatatgtgtagtcatttgtggttattttggcaagtaaatgtcagtgtatacttacatttttgcagcatgtactacaccttttttatgttggtgagtttgctaatccttatttgtaagacaagg

SEQ ID NO: 566 - DNA, 2526 bp, Homo sapiens
cagcacagcgttggtgctgcctgggtatcagaaagcaagctcacattgctctccagtacgtgtaagccttttcttttcaagatgcctgaggaagtgcaccatggagaggaggaggtggagacttttgcctttcaggcagaaattgcccaactcatatccctcatcatcaataccttctattccaacgaggagattttccttcaggagttgatctctaatgcttctgatgccttggacaagattcgctatgagagcctgacagacccttcaaagttggacagtggtaaagagctgaaaattgacatcatccccaaccctcaggaacgtaccctggctttggtagacacaggcattggcatgaccaaagctgatctcataaataatttgagaaccattgccaagtctggtactaaagcatgcatggaggctcttcaggctggtgcagacatctccatgattgggcagtttggtgttggcttttttctgcctacctggtggcagagaaactggttgtgatcacaaagcacaacgatgatgaacagtatgcttgggagtcttctgctggaggttccttcactgtgcatgctgaccatggtgagcccattggcaggggtaccaaagtgatcctccatcttaaagaagatcagacagagtacttagaagagaggcgggtcaaagaagtagtgaagaagcattctcagttcataggctatcccatcaccctttatttggagaaggaacaagacaaggaaattagtgatgatgaggcagaagaagagaaaggtgagaaagaagaggaagataaagatgacgaagaaaagcccaagatcaaagatgtgggttcagatgaggaggatgacagcagtaaggataagaagaagaaaactaagaagatcaaagagaaatacattgactaggaagaactaaacaagaccaagcctatttggaccagaaaccatgatgacatcacccaagaggagtatggagaattctataagagcctcaccagtgactgggaagaccacttggcagtcaagcacttttctgtagaaggtcagttggaattcagggcattgctattcagtcctcgtcgggctccctttgacctttttgagaacaagaagaaaaagaacaacatcaaactgtatgtccgccgtgtgttcatcatggacagctgtgatgagttgataccagagtatctcaattttatccatggtgtggttgactctgaggatctgcccctgaacatctcccgagaaatgctccagcagagcaaaatcttgaaagtcattcgcaaaaacattgttaagaagtgccttgagctcttctctgagctggcagaagacaaggagattataagaaattctatgaggcattttctaaaaatctcaagcttggaatccacgaagactccactaaccgccaccgcctgtctgagctgctgcgctgtcacacctcccagtctggagatgagatgacatctctgtcgtagtatgtttctcacatgaaggagacacagaagtccacctattacatcactggtgagagcaaagagcaggtggccaactctgcttttgtggagcgagtgcggaaacagggcttcgaggtggtatatatgactgagcccattgacgagtactgtgtgcagcagctcaaggagtttgatgggaaaagcctggtctcagttaccaaggagggtctggagctacctgaggatgaggaggagaagaagaagatggaagaaagcaaggaaaagtttgagaacctctgcaagctcatgaaagaaatcttagataagaaggttgagaaggtgacaatctccaatagacttgtgtcttcaccctgctgcattgtgaccagcacctacggctggacagccaatatggagcagatcatgaaagcccaggcacttcgggacaactccaccatgggctatatgatggccaaaaagcacctggagatcaaccccgaccaccccatcatggagacgctgcggcagaaggctgaggccgacaagaatgataaggcagttaaggacctggtggtgctgctgtttgaaaccgccctgctatcttcgggcttttcccttgaggatccccagacccactccaaccacatctaccacatgatcaagctaggtctaggtactgatgaagatgaagtggcagcagaggaacccagtgatgcagttcctgatgagatcccccctcttgagggtgatgaggatgcgtctcgcatggaagaagtcgattaggagttcatagttggaaaacttgtgcccttgtatagtgtccccatggctcccactgcagcctcgagtgcccctgtcccacctggctgctggtgtctagtgtttttttccctctcctgtccttgtgttgaaggcaggaaaccaagggtgtcaagccccattccctctctactcttgacagcaggattggatgttgtgtattgtggtttattttattttcttcattttgttctgaaattaaagaatgtaaaataaagaatatgccgtttttatac

SEQ ID NO: 567 - DNA, 3718 bp, Homo sapiens
ccccgcagccctcccgggacacggtggacacgcttgtcccagacctgggcgccctcctgccgggagccaggactggccgcagcaggcgctgtccgggcccgtgggcggggtttcgggagggggcggagccaggcccacggccggtgtcaggttgctccggtaacggtgacgtttcgcggcgtgggcggggccagcacgcaggttgcatattttaggaagtgaggaggaggcgcgggctggagctgcggcggggtctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctgccttagcatctggctttttgatggaagagcacctcgcctaaaggatttccagaccctcagagtatactaaactgcagatgaggcccttctctttcagtctaaaagagacctgaagccttcctgctttccctccagagatcaccaccacatctcaagtgtctctagcccagggcttatctgagaagcagaaatctatcccacacagtctgcctgggcatgtgtgctgagaagtggttcccttccttccatataatgtgttcctaatttagcatcaatgacacaatt

SEQ ID NO: 568 - DNA, 2857 bp, Homo sapiens
ccccgcagccctcccgggacacggtggacacgcttgtcccagacctgggcgccctcctgccgggagccaggactggccgcagcaggcgctgtccgggcccgtgggcggggtttcgggagggggcggagccaggcccacggccggtgtcaggttgctccggtaacggtgacgtttcgcggcgtgggcggggccagcacgcaggttgcatattttaggaagtgaggaggaggcgcgggctggagctgcggcggggtctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctaccttctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctgccttagcatctggctttttgatggaagagcacctcgcctaaaggatttccagaccctcagagtatactaaactgcagatgaggcccttctctttcagtctaaaagagacctgaagccttcctgctttccctccagagatcaccaccacatctcaagtgtctctagcccagggcttatctgagaagcagaaatctatcccacacagtctgcctgggcatgtgtgctgagaagtggttcccttccttccatataatgtgttcctaatttagcatcaatgacacaatt

SEQ ID NO: 569 - DNA, 3634 bp, Homo sapiens
ccccgcagccctcccgggacacggtggacacgcttgtcccagacctgggcgccctcctgccgggagccaggactggccgcagcaggcgctgtccgggcccgtgggcggggtttcgggagggggcggagccaggcccacggccggtgtcaggttgctccggtaacggtgacgtttcgcggcgtgggcggggccagcacgcaggttgcatattttaggaagtgaggaggaggcgcgggctggagctgcggcggggtctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaagacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctgccttagcatctggctttttgatggaagagcacctcgcctaaaggatttccagaccctcagagtatactaaactgcagatgaggcccttctctttcagtctaaaagagacctgaagccttcctgctttccctccagagatcaccaccacatctcaagtgtctctagcccagggcttatctgagaagcagaaatctatcccacacagtctgcctgggcatgtgtgctgagaagtggttcccttccttccatataatgtgttcctaatttagcatcaatgacacaatt

SEQ ID NO: 570 - DNA, 4212 bp, Homo sapiens
caagcgcccggggaggccatccgcaggtgggcgcggggcctggattccacagaggggcggagtccctcagtcaggcgctggctgcaatcacacccgagcgccagccccctccagcatccctgagtcccagaggagatcgccgaagcgctggaaaagccgttccgcccacgacttctggtgccgggtcggcggcgactgggggagcccagttccgagaccgtaccgcacccactgcggacctcctgggccctacatagttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctgccttagcatctggctttttgatggaagagcacctcgcctaaaggatttccagaccctcagagtatactaaactgcagatgaggcccttctctttcagtctaaaagagacctgaagccttcctgctttccctccagagatcaccaccacatctcaagtgtctctagcccagggcttatctgagaagcagaaatctatcccacacagtctgcctgggcatgtgtgctgagaagtggttcccttccttccatataatgtgttcctaatttagcatcaatgacacaatt

SEQ ID NO: 571 - DNA, 4516 bp, Homo sapiens
ccccgcagccctcccgggacacggtggacacgcttgtcccagacctgggcgccctcctgccgggagccaggactggccgcagcaggcgctgtccgggcccgtgggcggggtttcgggagggggcggagccaggcccacggccggtgtcaggttgctccggtaacggtgacgtttcgcggcgtgggcggggccagcacgcaggttgcatattttaggaagtgaggaggaggcgcgggctggagctgcggcggggtctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggttggacgtgataagtatgagcctgcagctgtttcagaacaaggtgataaaaagggcaaaaagggcaaaaaagacagggacatggatgaactgaagaaagaagtttctatggatgatcataaacttagccttgatgaacttcatcgtaaatatggaacagacttgagccggggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatctgtacctgggtgtggtgctatcagccgttgtaatcataactggttgcttctcctactatcaagaagctaaaagttcaaagatcatggaatccttcaaaaacatggtccctcagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtggataactcctcgctcactggtgaatcagaaccccagactaggtctccagatttcacaaatgaaaaccccctggagacgaggaacattgccttcttttcaaccaattgtgttgaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtgtctcttttgacaagacttcagctacctggcttgctctgtccagaattgcaggtctttgtaacagggcagtgtttcaggctaaccaggaaaacctacctattcttaagcgggcagttgcaggagatgcctctgagtcagcactcttaaagtgcatagagctgtgctgtggttccgtgaaggagatgagagaaagatacgccaaaatcgtcgagatacccttcaactccaccaacaagtaccagttgtctattcataagaaccccaacacatcggagccccaacacctgttggtgatgaagggcgccccagaaaggatcctagaccgttgcagctctatcctcctccacggcaaggagcagcccctggatgaggagctgaaagacgcctttcagaacgcctatttggagctggggggcctcggagaacgagtcctaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggttcctgccatctccctggcttatgagcaggctgagagtgacatcatgaagagacagcccagaaatcccaaaacagacaaacttgtgaatgagcggctgatcagcatggcctatgggcagattggaatgatccaggccctgggaggcttctttacttactttgtgattctggctgagaacggcttcctcccaattcacctgttgggcctccgagtggactgggatgaccgctggatcaacgatgtggaagacagctacgggcagcagtggacctatgagcagaggaaaatcgtggagttcacctgccacacagccttcttcgtcagtatcgtggtggtgcagtgggccgacttggtcatctgtaagaccaggaggaattcggtcttccagcaggggatgaagaacaagatcttgatatttggcctctttgaagagacagccctggctgctttcctttcctactgccctggaatgggtgttgctcttaggatgtatcccctcaaacctacctggtggttctgtgccttcccctactctcttctcatcttcgtatatgacgaagtcagaaaactcatcatcaggcgacgccctggcggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctgccttagcatctggctttttgatggaagagcacctcgcctaaaggatttccagaccctcagagtatactaaactgcagatgaggcccttctctttcagtctaaaagagacctgaagccttcctgctttccctccagagatcaccaccacatctcaagtgtctctagcccagggcttatctgagaagcagaaatctatcccacacagtctgcctgggcatgtgtgctgagaagtggttcccttccttccatataatgtgttcctaatttagcatcaatgacacaatt

SEQ ID NO: 572 - DNA, 5245 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgc

SEQ ID NO: 573 - DNA, 5929 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacgagttaccggctgaagaaggaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaaggcaaggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaaccaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgat

SEQ ID NO: 574 - DNA, 5924 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaaggcaaggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaaccaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgat

SEQ ID NO: 575 - DNA, 4450 bp, Homo sapiens
gcgcgcgggaggagggagccgggaggagggggcggggccgcgccgcccgcgccgcgctgggcgctctcggccaatgagcggcgtccacatgccgcggcggcggcgaaaggggaggcagcggccgataaatgctattagagcagccgccgcggagccgtccccgacgccacctccttttccttcgccgcagtttcctccgccgctgtcgggcgtgcggcgctgagggacccgggcgagcgcgccgcgcaccgccccgccggctcgcctccctcgccgcgttccgccctcagtggtctgccgggcgccccctcctccggcccgggcggggcctctgatcgcctcaagagagcggggagggggctcgggggccgcggcctgccctcccggcgggcggctgagggcgagggaggccctcccttctggcgaggggagggagggtgggtcaggagcccccaacccgccctgcggagctcggggccgcgcgaggggcggttgtctgggggagggggcgcggggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgaaaaaccttgctggaacttgtgattgagcagtttgaagacttgctagttaggattttattactggcagcatgtatatcttttgttttggcttggtttgaagaaggtgaagaaacaattacagcctttgtagaaccttttgtaattttactcatattagtagccaatgcaattgtgggtgtatggcaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctgttggtgacaaagttcctgctgatataaggttaacttccatcaaatctaccacactaagagttgaccagtcaattctcacaggtgaatctgtctctgtcatcaagcacactgatcccgtccctgacccacgagctgtcaaccaagataaaaagaacatgctgttttctggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcaggatgttcattctggacagagtggaaggtgatacttgttcccttaatgagtttaccataactggatcaacttatgcacctattggagaagtgcataaagatgataaaccagtgaattgtcaccagtatgatggtctggtagaattagcaacaatttgtgctctttgtaatgactctgctttggattacaatgaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtcattaaacagctgatgaaaaaggaattcactctagagttttcacgtgacagaaagtcaatgtcggtttactgtacaccaaataaaccaagcaggacatcaatgagcaagatgtttgtgaagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatgactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctgtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgttacgtcggcgctgctaccgtgggtgctgctgcatggtggttcattgctgctgacggtggtccaagagtgtccttctaccagctgagtcatttcctacagtgtaaagaggacaacccggactttgaaggcgtggattgtgcaatctttgaatccccatacccgatgacaatggcgctctctgttctagtaactatagaaatgtgtaacgccctcaacagcttgtccgaaaaccagtccttgctgaggatgcccccctgggagaacatctggctcgtgggctccatctgcctgtccatgtcactccacttcctgatcctctatgtcgaacccttgccactcatcttccagatcacaccgctgaacgtgacccagtggctgatggtgctgaaaatctccttgcccgtgattctcatggatgagacgctcaagtttgtggcccgcaactacctggaacctgcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgat

SEQ ID NO: 576 - DNA, 5477 bp, Homo sapiens
tctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaaggtaggggctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggggtcagctgtctctgtccccacccaccctccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaagaaatctcttccataattcagatttctacactttatacttgcctccctcctaaatcgtgatattgaaatatgtg

SEQ ID NO: 577 - DNA, 4716 bp, Homo sapiens
tctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaacccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtctccattctctaagcctggcttagaaggcactgggaatgtcctgtagagagagacctagataggtcatgcaagtgagaaagacatctgaggaa

SEQ ID NO: 578 - DNA, 5510 bp, Homo sapiens
tctctgtctgccagggtctccgactgtcccagacgggctggtgtgggcttgggatcctcctggtgacctctcccgctaaggtccctcagccactctgccccaagatgggccgtggggctggccgtgagtactcacctgccgccaccacggcagagaatgggggcggcaagaagaaacagaaggagaaggaactggatgagctgaagaaggaggtggcaatggatgaccacaagctgtccttggatgagctgggccgcaaataccaagtggacctgtccaagggcctcaccaaccagcgggctcaggacgttctggctcgagatgggcccaacgccctcacaccacctcccacaacccctgagtgggtcaagttctgccgtcagcttttcggggggttctccatcctgctgtggattggggctatcctctgcttcctggcctacggcatccaggctgccatggaggatgaaccatccaacgacaatctatatctgggtgtggtgctggcagctgtggtcattgtcactggctgcttctcctactaccaggaggccaagagctccaagatcatggattccttcaagaacatggtacctcagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtggataactcatccttaacaggagagtcggagccccagacccgctcccccgagttcacccatgagaaccccctggagacccgcaatatctgtttcttctccaccaactgtgttgaaggcactgccaggggcattgtgattgccacaggagaccggacggtgatgggccgcatagctactctcgcctcaggcctggaggttgggcggacacccatagcaatggagattgaacacttcatccagctgatcacaggggtcgctgtattcctgggggtctccttcttcgtgctctccctcatcctgggctacagctggctggaggcagtcatcttcctcatcggcatcatagtggccaacgtgcctgaggggcttctggccactgtcactgtgtgcctgaccctgacagccaagcgcatggcacggaagaactgcctggtgaagaacctggaggcggtggagacgctgggctccacgtccaccatctgctcggacaagacgggcaccctcacccagaaccgcatgaccgtcgcccacatgtggttcgacaaccaaatccatgaggctgacaccaccgaagatcagtctggggccacttttgacaaacgatcccctacgtggacggccctgtctcgaattgctggtctctgcaaccgcgccgtcttcaaggcaggacaggagaacatctccgtgtctaagcgggacacagctggtgatgcctctgagtcagctctgctcaagtgcattgagctctcctgtggctcagtgaggaaaatgagagacagaaaccccaaggtggcagagattcctttcaactctaccaacaagtaccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtgatcatggtaaccggggatcaccctatcacagccaaggccattgccaaaggcgtgggcatcatatcagagggtaacgagactgtggaggacattgcagcccggctcaacattcccatgagtcaagtcaaccccagagaagccaaggcatgcgtggtgcacggctctgacctgaaggacatgacatcggagcagctcgatgagatcctcaagaaccacacagagatcgtctttgctcgaacgtctccccagcagaagctcatcattgtggagggatgtcagaggcagggagccattgtggccgtgacgggtgacggggtgaacgactcccctgcattgaagaaggctgacattggcattgccatgggcatctctggctctgacgtctctaagcaggcagccgacatgatcctgctggatgacaactttgcctccatcgtcacgggggtggaggagggccgcctgatctttgacaacttgaagaaatccatcgcctacaccctgaccagcaacatccccgagatcacccccttcctgctgttcatcattgccaacatccccctacctctgggcactgtgaccatcctttgcattgacctgggcacagatatggtccctgccatctccttggcctatgaggcagctgagagtgatatcatgaagcggcagccacgaaactcccagacggacaagctggtgaatgagaggctcatcagcatggcctacggacagatcgggatgatccaggcactgggtggcttcttcacctactttgtgatcctggcagagaacggtttcctgccatcacggctactgggaatccgcctcgactgggatgaccggaccatgaatgatctggaggacagctatggacaggagtggacctatgagcagcggaaggtggtggagttcacgtgccacacggcattctttgccagcatcgtggtggtgcagtgggctgacctcatcatctgcaagacccgccgcaactcagtcttccagcagggcatgaagaacaagatcctgatttttgggctcctggaggagacggcgttggctgcctttctctcttactgcccaggcatgggtgtagccctccgcatgtacccgctcaaagtcacctggtggttctgcgccttcccctacagcctcctcatcttcatctatgatgaggtccgaaagctcatcctgcggcggtatcctggtggctgggtggagaaggagacatactactgaccccattggaagaagaaccaggcatggaaagatggggagctctggaggtgttgtggggatggtgatggagagggatggaaataacgggtggcattgggtggcaacatttggggagagataatgaggcaactcagcaggctaagttgcggggtatataaattggggtgatgaccccatagacctaactgtgaacaatcagattagacactatgtgttagagtccccccgaccagatccttttccatcccactccactatgttgtctattttttctgaggaattaagggttaccccaccctgcccactcccatcccttcaaccccacttcctactgtaatagatcagcatccaaaagcaggaacccatctaaaccagaaggaagccctctcagatcaccccagcctcactccatttcccacttccacccccgttagcttcctgcaggactctatccctggcttccccttcagaccttgcaatcacaaaaggttcttctggtgagtgcaagagcctgagactggaaaaggtggacttgtctcccagtcgaggctggtaagggaccttcagggagagctgggcagacaggtgggagatggaggtagggctggctggaggaaggaaacaacaaaggaagtgaggtagtgccaatgacaggacatttgacatgagtctccagatagatgtcgtggactccagctctacgtcccacattttagaataccccaccagcagaacaaactcagatctcatcagggtagcagcagaggcaggaccagaaggcaatcaagagcttccagaaatgccacacttgtgtgccacagagttccccgctgacccttggttaggggtcctcttagtccacaaggtccggatgtcactcatgtacttaataacacttcaccttctgtaatactaagtcctcagagctccatgctgttctgaaagggatggccacaagttctttcccagcctcttccattccctttcttttcatgcccatcccgatgaacctgcatcattccccgacactgccaagccaaccctggaaaaggagttcgctggccattggctagaatcagggtggagaagttccctgaaccttcctgtctcccagggacatgtatgcttccagggacaagcttaggtcatgaacatggtcagaacctttggacaagaggaaaaatactaagagatttgctttttctgggtgcggtggctcatgcctgtaatcccagcactttgggaggccgaggcaggtggatcatgaggtcaggagttcgaggcgagcctggccaacatggtgaaaccctgtctctactaaaagtacaaaaaattagccagtcatggtggcacacgcctgtaatctcagctactcaggaggctgaggcaggagaattgcttgaacctgtgaggaagaggttgcagtgagctgagatcgtgccattacactccagcctgggcgaaagggtgagactccatctcaaaaaaaaaaaaaatgatttgcttttgacgtcttaggtggcagggctgttccctccaggcaaatgcccttcaaaccgacgatcattgtgcccacttaccctgggctggagagttggtttcaggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaagaaatctcttccataattcagatttctacactttatacttgcctccctcctaaatcgtgatattgaaatatgtg

SEQ ID NO: 579 - DNA, 3345 bp, Homo sapiens
atgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgttgtctccacctcggtggccgcggctgttgctgctgtcgctgctcctgctgggggcggttcctggcccgcgccggagcggcgctttctacctgcccggcctggcgcccgtcaacttctgcgacgaagaaaaaaagagcgacgagtgcaaggccgaaatagaactatttgtgaacagacttgattcagtggaatcagttcttccttatgaatacacagcgtttgatttttgccaagcatcagaaggaaagcgcccatctgaaaatcttggtcaggtactattcggggaaagaattgaaccttcaccatataagtttacgtttaataagaaggagacctgtaagcttgtttgtacaaaaacataccatacagagaaagctgaagacaaacaaaagttagaattcttgaaaaaaagcatgttattgaattatcaacatcactggattgtggataatatgcctgtaacgtggtgttacgatgttgaagatggtcagaggttctgtaatcctggatttcctattggctgttacattacagataaaggccatgcaaaagatgcctgtgttattagttcagatttccatgaaagagatacattttacatcttcaaccatgttgacatcaaaatatactatcatgttgttgaaactgggtccatgggagcaagattagtggctgctaaacttgaaccgaaaagcttcaaacatacccatatagataaaccagactgctcagggccccccatggacataagtaacaaggcttctggggagataaaaattgcctatacttactctgttagcttcgaggaagatgataagatcagatgggcgtctagatgggactatattctggagtctatgcctcatacccacattcagtggtttagcattatgaattccctggtcattgttctcttcttatctggaatggtagctatgattatgttacggacactgcacaaagatattgctagatataatcagatggactctacggaagatgcccaggaagaatttggctggaaacttgttcatggtgatatattccgtcctccaagaaaagggatgctgctatcagtctttctaggatccgggacacagattttaattatgacctttgtgactctatttttcgcttgcctgggatttttgtcacctgccaaccgaggagcgctgatgacgtgtgctgtggtcctgtgggtgctgctgggcacccctgcaggctatgttgctgccagattctataagtcctttggaggtgagaagtggaaaacaaatgttttattaacatcatttctttgtcctgggattgtatttgctgacttctttataatgaatctgatcctctggggagaaggatcttcagcagctattccttttgggacactggttgccatattggccctttggttctgcatatctgtgcctctgacgtttattggtgcatactttggttttaagaagaatgccattgaacacccagttcgaaccaatcagattccacgtcagattcctgaacagtcgttctacacgaagcccttgcctggtattatcatgggagggattttgccctttggctgcatctttatacaacttttcttcattctgaatagtatttggtcacaccagatgtattacatgtttggcttcctatttctggtgtttatcattttggttattacctgttctgaagcaactatacttctttgctatttccacctatgtgcagaggattatcattggcaatggcgttcattccttacgagtggctttactgcagtttatttcttaatctatgcagtacactacttcttttcaaaactgcagatcacgggaacagcaagcacaattctgtactttggttataccatgataatggttttgatcttctttctttttacaggaacaattggcttctttgcatgcttttggtttgttaccaaaatatacagtgtggtgaaggttgactgaagaagtccagtgtgtccagttaaaacagaaataaattaaactcttcatcaacaaagacctgtttttgtgactgccttgagttttatcagaattattggcctagtaatccttcagaaacaccgtaattctaaataaacctcttcccatacacctttcccccataagatgtgtcttcaacactataaagcatttgtattgtgatttgattaagtatatatttggttgttctcaatgaagagcaaatttaaatattatgtgcatttgtaaatacagtagctataaaattttccatacttctaatggcagaatagaggaggccatattaaataatactgatgaaaggcaggacactgcattgtaaataggattttctaggctcggtaggcagaaagaattatttttctttgaaggaaataactttttatcatggtaattttgaaggatgattcctatgatgtgttcaccaggggaatgtggcttttaaagaaaatcttctattggttgtaactgttcatatcttcttacttttctgtgttgacttcattattcccatggtattggccttttaaactatgtgcctctgagtctttcaatttataaatttgttatcttaataaatattataaaaatgtcttcattgcatcattacctattatatattcaaggaggttctgtaaatacagatctatttaccaaggtgttttgaaatgatttatactattttatcagattttactggattttgttaatgtaacactttctgagttttgatctgaatggaatttcactgtgtaaggcattgtctaaaatgttcactgtgaggcagtagaggaggttgaagtcatgcatatctagacagatgaattatctgcaagtacttaaggtggagccttactacattgtcattaaggagtttctatttttgacttgtttttcaaaatacagtgttttaagtcaggttttattacctggacattagcaatcactagcaagtcttcatctttatgatttcattgttttaatttagatttcacaaacagttttacttctaagagttaagaaatgcactgtctttcacattcatctgactaattgaaatccatttatgtagaatataggaatggggggtgattctgaagtatcgg

SEQ ID NO: 580 - DNA, 2271 bp, Homo sapiens
ctggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtgtgagtgaggtggggaaacacagatggactttggggggctcccccttctacaggaaacccggagtggactggaatggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaa

SEQ ID NO: 581 - DNA, 1550 bp, Homo sapiens
cacgagggactcactggtgcctgccttggggctccgggactgtgggctgtctccatccggagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaa

SEQ ID NO: 582 - DNA, 1517 bp, Homo sapiens
ctgggacctgctctgggcaagcacaggcgccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaa

SEQ ID NO: 583 - DNA, 1558 bp, Homo sapiens
ctggtgcctgccttggggctccgggactgtgggctgtctccatccggaggtctccctaccaccaggctctccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaa

SEQ ID NO: 584 - DNA, 3459 bp, Homo sapiens
ctggtgcctgccttggggctccgggactgtgggctgtctccatccggaggtctccctaccaccaggctctgtggggcagggaagcccagtggggtgcagggagccaggaagctggggtggggtcagggcagggtccacagggagaccgggcgaggctggcagccttcccagtccgcgcagcgtctctgcagggggagcaagagctgcccttccacccctcccaggggacgggtaggggcactctgggcttttcccaccccctcacgcagggacacaggcctggtgggtctatgactgaaattggccagaccgcattctggtggttttattcggaagggaagtttaccctgttcagcagaagctgagatgggaacaggaaacccacagggcccctttattcggcaaaaatgtcagtcagcgccccggggagcagccgagggtccctgagtgtgtgagtgaggtggggaaacacagatggactttggggggctcccccttctacaggaaacccggagtggactggaatggtgcagggggagaactcgcccctcccatcgggcgcctccttcataccggcccttcccctcggctttgcctggacagctcctgcctcccgcagggcccacctgtgtcccccagcgccgctccacccagcaggcctgagcccctctctgctgccagacaccccctgctgcccactctcctgctgctcgggttctgaggcacagcttgtcacaccgaggcggattctctttctctttctctttctcttctggcccacagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccaggtaagaggccagcacagccggcccagcctccgcttgggcagcctggatgcccccgcaccctgcaccctctctccatggccacagtgccccaggaaggccccggctgccccaggccaggtcccaaccccatctccatggatgcaccctgcaggggacgccttgaggtcagcctccggcccccgtccacctctgtctcacctctcactttgtcaccgccaggtgggccatcctgagcttggcgactgacccttatccctcgtccttggctcctctggtgcccggggtgggtgcccagacctctcctgtgcccacgtccctagctgcaaagtggaatgggatggtgctgggactctccggccggcactcgggcctgctgcttccccacagggcttcttgtccctttctcctccagatattggttccccctgtgacctcaggggaagaggtcacctggaggctggtgcccacctgagtccaggcagacagaaaggggaaccagacccagaggtggcctttgagtcactgagcgcagagcctgtccatgcggccaacggctctgtccccttggagcctcatgccaggctcagcatggccagtgctccctgcggccaggcaggactgcacctgcgggacagggctgacggcacacctgggggcagggcctgagcctacagggaggcacagggcaggtgggctagccatgaacagaagaggaagctggagtgctttgggggttcatgcatgtaggctgggatttggggctcacacctcaacctgcatgcccagttccatgcccctcccctcttgtgaaagcacctgtctacttgggctgaggatgtgggggcacaggtggcaggtgaggctgccctcaggaggggcccaggcccagcttgtaccccacctccaccagtacctgaagaagtggggctctcaccctacctgcctctgccattggaatggcctggtttgcacagatgggaaacccgtttgcggggtgggtgtctgggtgggcacgtggggcgaggacctgcctgcgggaccctgccctggaactgacagtgcaagctcggcgtcctgcccatctgggcagaaggctggtttctcccatcaacgaagccctcccaggaccttcctgcaagccctcgtcccacacgcagctctgccgtcccttggtgtccctcccggcctcaggtcctccatgctgggtacctctgggcacctcgtttggctgagccaggggttcagcctggcagggcgccctggcagcagtccttggcctgtggatgctgtcctggcccgtggatggtgtcccggcctccacgtacccctctcagcccctcctcttggactccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccaggccaagtgtggagaaatcaatgatgttgacgatgaggctccctgagagaaatcacacccagcgggagctgctgctcccaggtctggcctcggtcaccagccacctgctgcatccgcgggagtggggccgaggacatgggagtggcaggtgcagcccccggtactcactcagccccagggagtgtccctggctcccagggctctgggaggtgagggcaggtcccgggggaggctgggttagtggcagctccgggatgagacctcagaggtctgtctgacttgtccaagcccggctatggggaggtggggggaaggaaggaagaggaagaagtgggaggcagccagcagcgcagggccctgagagtatttcagcggcaccgctgtcctgggccgcccggtgccacatctttgaaaacagttgtttaatttaagcttgtccactcagtagctgttgaatgtgggaggttatcttgttctattcaagttgctataaaaataaaaactaccatagactggg

SEQ ID NO: 585 - DNA, 2492 bp, Homo sapiens
cacgagggactcactggtgcctgccttggggctccgggactgtgggctgtctccatccggagccgcagcaatggcgctgagttcctctgctggagttcatcctgctagctgggttcccgagctgccggtctgagcctgaggcatggagcctcctggagactgggggcctcctccctggagatccacccccaaaaccgacgtcttgaggctggtgctgtatctcaccttcctgggagccccctgctacgccccagctctgccgtcctgcaaggaggacgagtacccagtgggctccgagtgctgccccaagtgcagtccaggttatcgtgtgaaggaggcctgcggggagctgacgggcacagtgtgtgaaccctgccctccaggcacctacattgcccacctcaatggcctaagcaagtgtctgcagtgccaaatgtgtgacccagatattggttccccctgtgacctcaggggaagaggtcacctggaggctggtgcccacctgagtccaggcagacagaaaggggaaccagacccagaggtggcctttgagtcactgagcgcagagcctgtccatgcggccaacggctctgtccccttggagcctcatgccaggctcagcatggccagtgctccctgcggccaggcaggactgcacctgcgggacagggctgacggcacacctgggggcagggcctgagcctacagggaggcacagggcaggtgggctagccatgaacagaagaggaagctggagtgctttgggggttcatgcatgtaggctgggatttggggctcacacctcaacctgcatgcccagttccatgcccctcccctcttgtgaaagcacctgtctacttgggctgaggatgtgggggcacaggtggcaggtgaggctgccctcaggaggggcccaggcccagcttgtaccccacctccaccagtacctgaagaagtggggctctcaccctacctgcctctgccattggaatggcctggtttgcacagatgggaaacccgtttgcggggtgggtgtctgggtgggcacgtggggcgaggacctgcctgcgggaccctgccctggaactgacagtgcaagctcggcgtcctgcccatctgggcagaaggctggtttctcccatcaacgaagccctcccaggaccttcctgcaagccctcgtcccacacgcagctctgccgtcccttggtgtccctcccggcctcaggtcctccatgctgggtacctctgggcacctcgtttggctgagccaggggttcagcctggcagggcgccctggcagcagtccttggcctgtggatgctgtcctggcccgtggatggtgtcccggcctccacgtacccctctcagcccctcctcttggactccagccatgggcctgcgcgcgagccggaactgctccaggacagagaacgccgtgtgtggctgcagcccaggccacttctgcatcgtccaggacggggaccactgcgccgcgtgccgcgcttacgccacctccagcccgggccagagggtgcagaagggaggcaccgagagtcaggacaccctgtgtcagaactgccccccggggaccttctctcccaatgggaccctggaggaatgtcagcaccagaccaagtgcagctggctggtgacgaaggccggagctgggaccagcagctcccactgggtatggtggtttctctcagggagcctcgtcatcgtcattgtttgctccacagttggcctaatcatatgtgtgaaaagaagaaagccaaggggtgatgtagtcaaggtgatcgtctccgtccagcggaaaagacaggaggcagaaggtgaggccacagtcattgaggccctgcaggcccctccggacgtcaccacggtggccgtggaggagacaataccctcattcacggggaggagcccaaaccactgacccacagactctgcaccccgacgccagagatacctggagcgacggctgctgaaagaggctgtccacctggcggaaccaccggagcccggaggcttgggggctccgccctgggctggcttccgtctcctccagtggagggagaggtggggcccctgctggggtagagctggggacgccacgtgccattcccatgggccagtgagggcctggggcctctgttctgctgtggcctgagctccccagagtcctgaggaggagcgccagttgcccctcgctcacagaccacacacccagccctcctgggccagcccagagggcccttcagaccccagctgtctgcgcgtctgactcttgtggcctcagcaggacaggccccgggcactgcctcacagccaaggctggactgggttggctgcagtgtggtgtttagtggataccacatcggaagtgattttctaaattggatttgaattcggctcctgttttctatttgtcatgaaacagtgtatttggggagatgctgtgggaggatgtaaatatcttgtttctcctcaaa

SEQ ID NO: 586 - DNA, 3911 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggttcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaa

SEQ ID NO: 587 - DNA, 3322 bp, Homo sapiens
attaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatgctcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggttcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaa

SEQ ID NO: 588 - DNA, 3967 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactggatttaattgctattcctgactttgcacctggagccatggaaaattggggcctcattacatatagggagacgtcactgctttttgaccccaagacctcttctgcttccgataaactgtgggtcaccagagtcatagcccatgaactggcgcaccagtggtttggcaacctggtcacaatggaatggtggaatgatatttggcttaaggagggttttgcaaaatacatggaacttatcgctgttaatgctacatatccagagctgcaatttgatgactattttttgaatgtgtgttttgaagtaattacaaaagattcattgaattcatcccgccctatctccaaaccagcggaaaccccgactcaaatacaggaaatgtttgatgaagtttcctataacaagggagcttgtattttgaatatgctcaaggattttctgggtgaggagaaattccagaaaggaataattcagtacttaaagaagttcagctatagaaatgctaagaatgatgacttgtggagcagtctgtcaaatagttgtttagaaagtgattttacatctggtggagtttgtcattcggatcccaagatgacaagtaacatggtgaggataaagagagtcacagagtagaagagatctgtggaatagcctgacctagactcgcctttctgggggaaaatgcagaggtcaaagagatgatgactacatggactctccagaaaggaatccccctgctggtggttaaacaagacgggtgttcactccgactgcaacaggagcgcttcctccagggggttttccaggaagaccctgaatggagggccctgcaggagaggtacctgtggcatatcccattgacctactccacgagttcttctaatgtgatccacagacacattctaaaatcaaagacagatactctggatctacctgaaaagaccagttgggtgaaatttaatgtggactcaaatggttactacatcgttcactatgagggtcatggatgggaccaactcattacacagctgaatcagaaccacacacttctcagacctaaggacagagtaggtctgattcatgatgtgtttcagctagttggtgcagggagactgaccctagacaaagctcttgacatgacttactacctccaacatgaaacaagcagccccgcacttctcgaaggtctgagttacttggaatcgttttaccacatgatggacagaaggaatatttcagatatctctgaaaacctcaagcgttaccttcttcagtattttaagccagtgattgacaggcaaagctggagtgacaagggttcagtctgggacaggatgctccgctcggctctcttgaagctggcctgtgacctgaaccatgctccttgcatccagaaagctgctgaactcttctcccagtggatggaatccagtggaaaattaaatataccaacagatgttttaaagattgtgtattctgtgggtgctcagacaacagcaggatggaattaccttttagagcaatatgaactgtcaatgtcaagtgctgaacaaaacaaaattctgtatgctttgtcaacgagcaagcatcaggaaaagttactgaagttaattgaactaggaatggaaggaaaggttatcaagacacagaacttggcagctctccttcatgcgattgccagacgtccaaaggggcagcaactagcatgggattttgtaagagaaaattggacccatcttctgaaaaaatttgacttgggctcatatgacataaggatgatcatctctggcacaacagctcacttttcttccaaggataagttgcaagaggtgaaactattttttgaatctcttgaggctcaaggatcacatctggatatttttcaaactgttctggaaacgataaccaaaaatataaaatggctggagaagaatcttccgactctgaggacttggctaatggttaatacttaaatggtcaatagaaaaagtaggctgggcgcggtggctcacgcctgtaatcccagcactttgggaggctgagaagggcggatcacgaggtcaggagatggagaccatcctggctaacacggtgagaccccgtctccgctaaaaatacaaaaaattagccgggcatggtggcaggtgcctgtagtcccagctactcggcaggctgcagcaggaaaatggcataaacccgggaggtggagcttgcagtgagccgagattgcaccactgcattccagcctgggtgactgagcgagactctgtctcaaaaaaaaaaaaaaaaa

SEQ ID NO: 589 - DNA, 1863 bp, Homo sapiens
cccaactcaaacaggcagataaagagagatcaaagagatgagcatgagatacagtcccctcgtgcccaaggagacagggtggttacagacatggaaaatctgagaataatcacctctgataaagatcacagaagctgcccgggaggtgtttggtaagcttggagttacgtttgtggggtggatgggcagaagtcagatttcatagcactgaggatgcagcacaaggagaagttcaagatcaattcctaagacaacaacttggcactaaaaaacataaactatgttctgaaggctttaccctggggacaagggaagggaggtgataacagcagaagtggcagccactggcgatcctttctttccatggtttggcttctactccaaagccacttatttgtgcattctacaaaaagtttcttgtcctttttgaaataaagctcttatcctaagctccattcacacctgcgtgataatgaaccagctagtacttactgtactcaggaagcatgcaaagttctgaatcttagaacagaaagtgaaagcaaaagtaaattccccttcagtcaaatctgcagcagcatgatttaagattaaattcatgtattgaaaatattgttcagaccccatgtgacataactggagccagtgcagtgccatgaagaactacgagattagcctggatattaacttgtcttctagagaatagatttcatgttccattcttctgcaatggttaattcacacagaaaaccaatgtttaacattcacagaggattttactgcttaacagccatcttgccccaaatatgcatttgttctcagttctcagtgccatctagttatcacttcactgaggatcctggggctttcccagtagccactaatggggaacgatttccttggcaggagctaaggctccccagtgtggtcattcctctccattatgacctctttgtccaccccaatctcacctctctggactttgttgcatctgagaagatcgaagtcttggtcagcaatgctacccagtttatcatcttgcacagcaaagatcttgaaatcacgaatgccacccttcagtcagaggaagattcaagatacatgaaaccaggaaaagaactgaaagttttgagttaccctgctcatgaacaaattgcactgctggttccagagaaacttacgcctcacctgaaatactatgtggctatggacttccaagccaagttaggtgatggctttgaagggttttataaaagcacatacagaactcttggtggtgaaacaagaattcttgcagtaacagattttgagccaacccaggcacgcatggctttcccttgctttgatgaaccgttgttcaaagccaacttttcaatcaagatacgaagagagagcaggcatattgcactatccaacatgccaaaggttaagacaattgaacttgaaggaggtcttttggaagatcactttgaaactactgtaaaaatgagtacataccttgtagcctacatagtttgtgatttccactctctgagtggcttcacttcatcaggggtcaaggtgtccatctatgcatccccagacaaacggaatcaaacacattatgctttgcaggcatcactgaagctacttgatttttatgaaaagtactttgatatctactatccactctccaaactgggtatgttcaaattccacattattgtcttcatttttgctcataaaacttgctttgatctcttccctctttctctttctatgtgatttaaatgagcactgaggaattcagttagctcaggaaaaaataatttgttcctcagagatgattcttgagtgtagaaaataaaatatttatgacatgcc

SEQ ID NO: 590 - DNA, 1403 bp, Homo sapiens
cagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggttgggacccactccaaataatctcctcggtgtgggtggtggttctatagagggataaatgaataataaacattgttaaaatatacgataatgaataaagtaatcctttcatcaaatgtgggtaaatttcaagcatcaggagggggaaatggagtggaaacagctggggcaaggaggcaaagaagccaggcctgttttacaacaaatattaaattacttcaataatacaaacgagaggcccggtgcggtggctcatgcctgtaatcccagtcctttgggaggctgcgggaggattgcttgagcccaggagttctagaccagcctgggcaacatggcaaaaccccatctctaccaaaaaattaaaaaattagctgggaacgctgacacgagcctggagtcccagctacttgggaggctgaggtgggaggatagcttgagcccaaaacttttgaggctgcagtgagccctgatcacaccactgcactcc

SEQ ID NO: 591 - DNA, 971 bp, Homo sapiens
cagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctgagattatattatgcctggtgatcctgatctgcttcagtgcctccacaccaggctactcctccctgtcggtgattgagatgatccttgctgctattttctttgttgtctacatgtgtgacctgcacaccaagataccattcatcaactggccctggagtgatttcttccgaaccctcatagcggcaatcctctacctgatcacctccattgttgtccttgttgagagaggaaaccactccaaaatcgtcgcaggggtactgggcctaatcgctacgtgcctctttggctatgatgcctatgtcaccttccccgttcggcagccaagacatacagcagcccccactgaccccgcagatggcccggtgtaggcgaacttccctcatttctctctgcaatctgcaaataactcctccattgaaataactcctccccaccccaacaacaacattcccagcagaccaactcccaccccctctttgaggtaaaagtgcctttattgggagacttttgtcttccagcctgccaatcaaccctcctgggtgtggccaccatatgtgtgtgcctaggtcctccttctgcacgatccaataggagacaccagttctgactgaaccatgcccccacctaagtcacaaaatgagggaagtggggagttagatttcagagtccaggccctaggctgcgggaggattgcttgagcccaggagttctagaccagcctgggcaacatggc

SEQ ID NO: 592 - DNA, 5739 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttgttttttttttttgacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatcttgaaaaacttcctttctcttctgtgaacatcattggccagatccattttcagtggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 593 - DNA, 5674 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaatccaggcaactcctagtagtacaacggaagaaacagctacccagaaggaacagtggtttggcaacagatggcatgagggatatcgccaaacacccagagaagactcccattcgacaacagggacagctgcagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 594 - DNA, 4633 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcgagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 595 - DNA, 4874 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 596 - DNA, 4335 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 597 - DNA, 5053 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccagtacgtcttcaaataccatctcagcaggctgggagccaaatgaagaaaatgaagatgaaagagacagacacctcagtttttctggatcaggcattgatgatgatgaagattttatctccagcaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 598 - DNA, 4723 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccaatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcagagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 599 - DNA, 5468 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggaggttacatcttttacaccttttctactgtacaccccatcccagacgaagacagtccctggatcaccgacagcacagacagaatccctgctaccactttgatgagcactagtgctacagcaactgagacagcaaccaagaggcaagaaacctgggattggttttcatggttgtttctaccatcagagtcaaagaatcatcttcacacaacaacacaaatggctgcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 600 - DNA, 5452 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcaggtatgggttcatagaagggcacgtggtgattccccggatccaccccaactccatctgtgcagcaaacaacacaggggtgtacatcctcacatccaacacctcccagtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagcaaccctactgatgatgacgtgagcagcggctcctccagtgaaaggagcagcacttcaggagctttgatgagcactagtgctacagcaactgagacagcaaccaagaggcaagaaacctgggattggttttcatggttgtttctaccatcagagtcaaagaatcatcttcacacaacaacacaaatggctggtacgtcttcaaataccatctcagcaggctgggagccaaatgaagaaaatgaagatgaaagagacagacacctcagtttttctggatcaggcattgatgatgatgaagattttatctccagcaccatttcaaccacaccacgggcttttgaccacacaaaacagaaccaggactggacccagtggaacccaagccattcaaatccggaagtgctacttcagacaaccacaaggatgactgatgtagacagaaatggcaccactgcttatgaaggaaactggaacccagaagcacaccctcccctcattcaccatgagcatcatgaggaagaagagaccccacattctacaagcacaacagcctcagctcataccagccatccaatgcaaggaaggacaacaccaagcccagaggacagttcctggactgatttcttcaacccaatctcacaccccatgggacgaggtcatcaagcaggaagaaggatggatatggactccagtcatagtataacgcttcagcctactgcaaatccaaacacaggtttggtggaagatttggacaggacaggacctctttcaatgacaacgcagcagagtaattctcagagcttctctacatcacatgaaggcttggaagaagataaagaccatccaacaacttctactctgacatcaagcaataggaatgatgtcacaggtggaagaagagacccaaatcattctgaaggctcaactactttactggaaggttatacctctcattacccacacacgaaggaaagcaggaccttcatcccagtgacctcagctaagactgggtcctttggagttactgcagttactgttggagattccaactctaatgtcaatcgttccttatcaggagaccaagacacattccaccccagtggggggtcccataccactcatggatctgaatcagatggacactcacatgggagtcaagaaggtggagcaaacacaacctctggtcctataaggacaccccaaattccagaatggctgatcatcttggcatccctcttggccttggctttgattcttgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaacaaaaactacacatatgtattcctgatcgccaacctttcccccaccagctaaggacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 601 - DNA, 905 bp, Homo sapiens
gcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaagtgtacacacaggggccacccggggttggggtgggagtgtggtggggggtagtggtggcaggacaagagaaggcattgagctttttctttcattttcctattaaaaaatacaaaaatcagc

SEQ ID NO: 602 - DNA, 849 bp, Homo sapiens
gcaggctggtcccctgacaggttgaagcaagtagacgcccaggagccccgggagggggctgcagtttccttccttccttctcggcagcgctccgcgcccccatcgcccctcctgcgctagcggaggtgatcgccgcggcgatgccggaggagggttcgggctgctcggtgcggcgcaggccctatgggtgcgtcctgcgggctgctttggtcccattggtcgcgggcttggtgatctgcctcgtggtgtgcatccagcgcttcgcacaggctcagcagcagctgccgctcgagtcacttgggtgggacgtagctgagctgcagctgaatcacacaggacctcagcaggaccccaggctatactggcaggggggcccagcactgggccgctccttcctgcatggaccagagctggacaaggggcagctacgtatccatcgtgatggcatctacatggtacacatccaggtgacgctggccatctgctcctccacgacggcctccaggcaccaccccaccaccctggccgtgggaatctgctctcccgcctcccgtagcatcagcctgctgcgtctcagcttccaccaaggttgtaccattgcctcccagcgcctgacgcccctggcccgaggggacacactctgcaccaacctcactgggacacttttgccttcccgaaacactgatgagaccttctttggagtgcagtgggtgcgcccctgaccactgctgctgattagggttttttaaattttattttattttatttaagttcaagagaaaaatgtggtggggggtagtggtggcaggacaagagaaggcattgagctttttctttcattttcctatt

SEQ ID NO: 603 - DNA, 5829 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 604 - DNA, 5648 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 605 - DNA, 5619 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacgactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 606 - DNA, 6017 bp, Homo sapiens
cgcccgcgcgctgcagccccatctcctagcggcagcccaggcgcggagggagcgagtccgccccgaggtaggtccaggacgggcgcacagcagcagccgaggctggccgggagagggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 607 - DNA, 5988 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactggctgcggctggaagttcgagcccctgctgggggaggagctggacctgcggcgcgtcacgtggcggctgcccccggagctcatcccgcgcctgtcggccagcagcgggcgctcctccgacgccgaggcgccccacgggcccccggacgacggcggcgcgggcgggaagggcggcagcctgccccgcagtgcgacacccgggccccccggagagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 608 - DNA, 5469 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 609 - DNA, 5778 bp, Homo sapiens
gccctcggacagtccctgctcgcccgcgcgctgcagccccatctcctagcggcagcccaggcgcggagggagcgagtccgccccgaggaggaagaggatggcagggccacgccccagcccatgggccaggctgctcctggcagccttgatcagcgtcagcctctctgggaccttggcaaaccgctgcaagaaggccccagtgaagagctgcacggagtgtgtccgtgtggataaggactgcgcctactgcacagacgagatgttcagggaccggcgctgcaacacccaggcggagctgctggccgcgggctgccagcgggagagcatcgtggtcatggagagcagcttccaaatcacagaggagacccagattgacaccaccctgcggcgcagccagatgtccccccaaggcctgcgggtccgtctgcggcccggtgaggagcggcattttgagctggaggtgtttgagccactggagagccccgtggacctgtacatcctcatggacttctccaactccatgtccgatgatctggacaacctcaagaagatggggcagaacctggctcgggtcctgagccagctcaccagcgactacactattggatttggcaagtttgtggacaaagtcagcgtcccgcagacggacatgaggcctgagaagctgaaggagccctggcccaacagtgacccccccttctccttcaagaacgtcatcagcctgacagaagatgtggatgagttccggaataaactgcagggagagcggatctcaggcaacctggatgctcctgagggcggcttcgatgccatcctgcagacagctgtgtgcacgagggacattggctggcgcccggacagcacccacctgctggtcttctccaccgagtcagccttccactatgaggctgatggcgccaacgtgctggctggcatcatgagccgcaacgatgaacggtgccacctggacaccacgggcacctacacccagtacaggacacaggactacccgtcggtgcccaccctggtgcgcctgctcgccaagcacaacatcatccccatctttgctgtcaccaactactcctatagctactacgagaagcttcacacctatttccctgtctcctcactgggggtgctgcaggaggactcgtccaacatcgtggagctgctggaggaggccttcaatcggatccgctccaacctggacatccgggccctagacagcccccgaggccttcggacagaggtcacctccaagatgttccagaagacgaggactgggtcctttcacatccggcggggggaagtgggtatataccaggtgcagctgcgggcccttgagcacgtggatgggacgcacgtgtgccagctgccggaggaccagaagggcaacatccatctgaaaccttccttctccgacggcctcaagatggacgcgggcatcatctgtgatgtgtgcacctgcgagctgcaaaaagaggtgcggtcagctcgctgcagcttcaacggagacttcgtgtgcggacagtgtgtgtgcagcgagggctggagtggccagacctgcaactgctccaccggctctctgagtgacattcagccctgcctgcgggagggcgaggacaagccgtgctccggccgtggggagtgccagtgcgggcactgtgtgtgctacggcgaaggccgctacgagggtcagttctgcgagtatgacaacttccagtgtccccgcacttccgggttcctctgcaatgaccgaggacgctgctccatgggccagtgtgtgtgtgagcctggttggacaggcccaagctgtgactgtcccctcagcaatgccacctgcatcgacagcaatgggggcatctgtaatggacgtggccactgtgagtgtggccgctgccactgccaccagcagtcgctctacacggacaccatctgcgagatcaactactcggcgatccacccgggcctctgcgaggacctacgctcctgcgtgcagtgccaggcgtggggcaccggcgagaagaaggggcgcacgtgtgaggaatgcaacttcaaggtcaagatggtggacgagcttaagagagccgaggaggtggtggtgcgctgctccttccgggacgaggatgacgactgcacctacagctacaccatggaaggtgacggcgcccctgggcccaacagcactgtcctggtgcacaagaagaaggactgccctccgggctccttctggtggctcatccccctgctcctcctcctcctgccgctcctggccctgctactgctgctatgctggaagtactgtgcctgctgcaaggcctgcctggcacttctcccgtgctgcaaccgaggtcacatggtgggctttaaggaagaccactacatgctgcgggagaacctgatggcctctgaccacttggacacgcccatgctgcgcagcgggaacctcaagggccgtgacgtggtccgctggaaggtcaccaacaacatgcagcggcctggctttgccactcatgccgccagcatcaaccccacagagctggtgccctacgggctgtccttgcgcctggcccgcctttgcaccgagaacctgctgaagcctgacactcgggagtgcgcccagctgcgccaggaggtggaggagaacctgaacgaggtctacaggcagatctccggtgtacacaagctccagcagaccaagttccggcagcagcccaatgccgggaaaaagcaagaccacaccattgtggacacagtgctgatggcgccccgctcggccaagccggccctgctgaagcttacagagaagcaggtggaacagagggccttccacgacctcaaggtggcccccggctactacaccctcactgcagaccaggacgcccggggcatggtggagttccaggagggcgtggagctggtggacgtacgggtgcccctctttatccggcctgaggatgacgacgagaagcagctgctggtggaggccatcgacgtgcccgcaggcactgccaccctcggccgccgcctggtaaacatcaccatcatcaaggagcaagccagagacgtggtgtcctttgagcagcctgagttctcggtcagccgcggggaccaggtggcccgcatccctgtcatccggcgtgtcctggacggcgggaagtcccaggtctcctaccgcacacaggatggcaccgcgcagggcaaccgggactacatccccgtggagggtgagctgctgttccagcctggggaggcctggaaagagctgcaggtgaagctcctggagctgcaagaagttgactccctcctgcggggccgccaggtccgccgtttccacgtccagctcagcaaccctaagtttggggcccacctgggccagccccactccaccaccatcatcatcagggacccagatgaactggaccggagcttcacgagtcagatgttgtcatcacagccaccccctcacggcgacctgggcgccccgcagaaccccaatgctaaggccgctgggtccaggaagatccatttcaactggctgcccccttctggcaagccaatggggtacagggtaaagtactggattcagggtgactccgaatccgaagcccacctgctcgacagcaaggtgccctcagtggagctcaccaacctgtacccgtattgcgactatgagatgaaggtgtgcgcctacggggctcagggcgagggaccctacagctccctggtgtcctgccgcacccaccaggaagtgcccagcgagccagggcgtctggccttcaatgtcgtctcctccacggtgacccagctgagctgggctgagccggctgagaccaacggtgagatcacagcctacgaggtctgctatggcctggtcaacgatgacaaccgacctattgggcccatgaagaaagtgctggttgacaaccctaagaaccggatgctgcttattgagaaccttcgggagtcccagccctaccgctacacggtgaaggcgcgcaacggggccggctgggggcctgagcgggaggccatcatcaacctggccacccagcccaagaggcccatgtccatccccatcatccctgacatccctatcgtggacgcccagagcggggaggactacgacagcttccttatgtacagcgatgacgttctacgctctccatcgggcagccagaggcccagcgtctccgatgacactgagcacctggtgaatggccggatggactttgccttcccgggcagcaccaactccctgcacaggatgaccacgaccagtgctgctgcctatggcacccacctgagcccacacgtgccccaccgcgtgctaagcacatcctccaccctcacacgggactacaactcactgacccgctcagaacactcacactcgaccacactgccgagggactactccaccctcacctccgtctcctcccacggcctccctcccatctgggaacacgggaggagcaggcttccgctgtcctgggccctggggtcccggagtcgggctcagatgaaagggttccccccttccaggggcccacgagactctataatcctggctgggaggccagcagcgccctcctggggcccagactctcgcctgactgctggtgtgcccgacacgcccacccgcctggtgttctctgccctggggcccacatctctcagagtgagctggcaggagccgcggtgcgagcggccgctgcagggctacagtgtggagtaccagctgctgaacggcggtgagctgcatcggctcaacatccccaaccctgcccagacctcggtggtggtggaagacctcctgcccaaccactcctacgtgttccgcgtgcgggcccagagccaggaaggctggggccgagagcgtgagggtgtcatcaccattgaatcccaggtgcacccgcagagcccactgtgtcccctgccaggctccgccttcactttgagcactcccagtgccccaggcccgctggtgttcactgccctgagcccagactcgctgcagctgagctgggagcggccacggaggcccaatggggatatcgtcggctacctggtgacctgtgagatggcccaaggaggagggccagccaccgcattccgggtggatggagacagccccgagagccggctgaccgtgccgggcctcagcgagaacgtgccctacaagttcaaggtgcaggccaggaccactgagggcttcgggccagagcgcgagggcatcatcaccatagagtcccaggatggaggacccttcccgcagctgggcagccgtgccgggctcttccagcacccgctgcaaagcgagtacagcagcatcaccaccacccacaccagcgccaccgagcccttcctagtggatgggctgaccctgggggcccagcacctggaggcaggcggctccctcacccggcatgtgacccaggagtttgtgagccggacactgaccaccagcggaacccttagcacccacatggaccaacagttcttccaaacttgaccgcaccctgccccacccccgccacgtcccactaggcgtcctcccgactcctctcccggagcctcctcagctactccatccttgcacccctgggggcccagcccacccgcatgcacagagcaggggctaggtgtctcctgggaggcatgaagggggcaaggtccgtcctctgtgggcccaaacctatttgtaaccaaagagctgggagcagcacaaggacccagcctttgttctgcacttaataaatggttttgctactgcta

SEQ ID NO: 610 - DNA, 3072 bp, Homo sapiens
gggaggctggggatggcgcgtggcccctttaagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtccttggggaagctgctggtctgggtgctgctggcctccaagctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcaaaacaatttctaagatttttttgctttatgtgggaaacagatctaaatctcattttatgctgtattttatatcttagttgtgtttgaaaacgttttgatttttggaaacacatcaaaataaataatggcgtttgttgtatgcagt

SEQ ID NO: 611 - DNA, 2975 bp, Homo sapiens
gggaggctggggatggcgcgtggcccctttaagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccagaccatgtcggtgattgggggcttgctcctggtggtggccctgggccctgggggtgtctccatggatgagaagaagaaggagtggtaacagtcacagatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcttttgctttatgtgggaaacagatctaaatctcattttatgctgtattttatatcttagttgtgtttgaaaacgttttgatttttggaaa

SEQ ID NO: 612 - DNA, 2878 bp, Homo sapiens
gggaggctggggatggcgcgtggcccctttaagacgcaccggggcgggcccgggcggcgcgcggcccctttaaggcttggcctacgtggcagccgctggagccgcagccgacgcggagcgaggccggccgccgggcacttcctgtggaggccgcagcgggtgcgggcgccgacgggcgagagccagcgagcgagcgagcgagccgagccgagcctcccgccgtcgccatgggccagaacgacctgatgggcacggccgaggacttcgccgaccagttcctccgtgtcacaaagcagtacctgccccacgtggcgcgcctctgtctgatcagcaccttcctggaggacggcatccgtatgtggttccagtggagcgagcagcgcgactacatcgacaccacctggaactgcggctacctgctggcctcgtccttcgtcttcctcaacttgctgggacagctgactggctgcgtcctggtgttgagcaggaacttcgtgcagtacgcctgcttcgggctctttggaatcatagctctgcagacgattgcctacagcattttatgggacttgaagtttttgatgaggaacctggccctgggaggaggcctgttgctgctcctagcagaatcccgttctgaagggaagagcatgtttgcgggcgtccccaccatgcgtgagagctcccccaaacagtacatgcagctcggaggcagggtcttgctggttctgatgttcatgaccctccttcactttgacgccagcttcttttctattgtccagaacatcgtgggcacagctctgatgattttagtggccattggttttaaaaccaagctggctgctttgactcttgttgtgtggctctttgccatcaacgtatatttcaacgccttctggaccattccagtctacaagcccatgcatgacttcctgaaatacgacttcttccaatccctacctgcctggctaagacccgtggccgtcaaggactggttcggggtggattcaacaaaactgccagcttttatgtatcctcttcccttcccctcccttggtaaaggcacagatgttttgagaactttatttgcagagacacctgagaatcgatggctcagtctgctctggagccacagtctggcgtctgacccttcagtgcaggccagcctggcagctggaagcctcccccacgccgaggctttggagtgaacagcccgcttggctgtggcatctcagtcctatttttgagtttttttgtgggggtacaggagggggccttcaagctgtactgtgagcagacgcattggtattatcattcaaagcagtctccctcttatttgtaagtttacatttttagcggaaactactaaattattttgggtggttcagccaaacctcaaaacagttaatctccctggtttaaaatcacaccagtggctttgatgttgtttctgccccgcattgtattttataggaatagtgaaaacatttagggacacccaaagaatgatgcagtattaaaggggtggtagaagctgctgtttatgataaaagtcatcggtcagaaaatcagcttggattggtgccaagtgttttattgggtaacaccctgggagttttagtagcttgaggcaaggtggaggggcaagaagtctggcagtgggaagggctagtgagaccacacaggggtagccccagcagcagcaccctgcaagccagcctggccagctgctcagaccagcttgcagagccgcagccgctgtgggcagggggtgtggcaggagctcccagcactggagacccacggactcaacccagttacctcacatggggccttttctgagcaaggtctcgaaagcgcaggccgccctggctgagcagcaccgccctttcccagctgcactcgccctgtggacagccccgacacaccactttcctgaggctgtcgctcactcagattgtccgtttgctatgccgaatgcagccaaaattcctttttacaatttgtgatgccttaccgatttgatcttaatcctgtatttaaagttttctaacactgccttatactgtgtttctctttttgggggagcttaactgcttgttgctccctgtcgtctgcaccatagtaaatgccacaagggtagtcgaacacctctctggcccctagacctatctggggacaggctggctcagcctgtctccagggctgctgcggcccagccccgagcctgcctccctcttggcctctcatccattggctctgcagggcaggggtgaggcaggtttctgctcataagtgcttttggaagtcacctacctttttaacacagccgaactagtcccaacgcgtttgcaaatattcccctggtagcctacttccttacccccgaatattggtaagatcgagcaatggcttcaggacatgggttctcttctcctgtgatcattcaagtgctcactgcatgaagactggcttgtctcagtgtttcaacctcaccagggctgtctcttggtccacacctcgctccctgttagtgccgtatgacagcccccatcaaatgaccttggccaagtcacggtttctctgtggtcaaggttggttggctgattggtggaaagtagggtggaccaaaggaggccacgtgagcagtcagcaccagttctgcaccagcagcgcctccgtcctagtgggtgttcctgtttctcctggccctgggtgggctagggcctgattcgggaagatgcctttgcagggaggggaggataagtgggatctaccaattgattctggcttttgctttatgtgggaaacagatctaaatctcattttatgctgtattttatatcttagttgtgtttgaaaacgttttgatttttggaaa

SEQ ID NO: 613 - DNA, 5069 bp, Homo sapiens
cgggctggagcgaaagaatgcgggggctgagcgcagaagcggctcgaggctggaagaggatcttgggcgccgccaggttctgtggacaatcacaatgggaatccaaggagggtctgtcctgttcgggctgctgctcgtcctggctgtcttctgccattcaggtgagtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggattctaagctctatgttttctatacattttcatctgtacttgcacctcactttacacaagaggaaactatgcaaagttagctggatcgctcaaggtcacttaggtaagttggcaagtccatgcttcccactcagctcctcaggtcagcaagtctacttctctgcctattttgtatactctctttaatatgtgcctagctttggaaagtctagaatgggtccctggtgcctttttactttgaagaaatcagtttctgcctctttttggaaaagaaaacaaagtgcaattgttttttactggaaagttacccaatagcatgaggtgaacaggacgtagttaggccttcctgtaaacagaaaatcatatcaaaacactatcttcccatctgtttctcaatgcctgctacttcttgtagatatttcatttcaggagagcagcagttaaacccgtggattttgtagttaggaacctgggttcaaaccctcttccactaattggctatgtctctggacaagtttttttttttttttttttttaaaccctttctgaactttcactttctatgtctacctcaaagaattgttgtgaggcttgagataatgcatttgtaaagggtctgccagataggaagatgctagttatggatttacaaggttgttaaggctgtaagagtctaaaacctacagtgaatcacaatgcatttacccccactgacttggacataagtgaaaactagccagaagtctctttttcaaattacttacaggttattcaatataaaatttttgtaatggataatcttatttatctaaactaaagcttcctgtttatacacactcctgttattctgggataagataaatgaccacagtaccttaatttctaggtgggtgcctgtgatggttcattgtaggtaaggacattttctctttttcagcagctgtgtaggtccagagcctctgggagaggaggggggtagcatgcacccagcaggggactgaactgggaaactcaaggttctttttactgtggggtagtgagctgcctttctgtgatcggtttccctagggatgttgctgttcccctccttgctattcgcagctacatacaacgtggccaaccccagtaggctgatcctatatatgatcagtgctggtgctgactctcaatagccccacccaagctggctataggtttacagatacattaattaggcaacctaaaatattgatgctggtgttggtgtgacataatgctatggccagaactgaaacttagagttataattcatgtattagggttctccagagggacagaattagtaggatatatgtatatatgaaagggaggttattagggagaactggctcccacagttagaaggcgaagtcgcacaataggccgtctgcaagctgggttagagagaagccagtagtggctcagcctgagttcaaaaacctcaaaactggggaagctgacagtgcagccagccttcagtctgtggccaaaggcccaagagcccctggcaaccaacccactggtgcaagtcctagattccaaaggctgaagaacctggagtctgatgtccaagagcaggaagagtggaagaaa

SEQ ID NO: 614 - DNA, 3653 bp, Homo sapiens
gcgcagaagcggctcgaggctggaagaggatcttgggcgccgccagtctctctctgttgcccaagctggagtgcagtggcacagtcttggctcactgcaacctccacctcctgggtgcaagcgattctcgtgtctcagcctctcaagtagctgggattacagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggatt

SEQ ID NO: 615 - DNA, 3446 bp, Homo sapiens
gttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggcttgatattttccaaatggatcctgttgggaaagaataaaattagcttgagcaacctggctaagatagaggggctctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccctcagattatttttcctctggctccttggatgtagtcagttagcatcattagtacatctttggagggtggggcaggagtatatgagcatcctctctcacatggaacgctttcataaacttcagggatcccgtgttgccatggaggcatgccaaatgttccatatgtgggtgtcagtcagggacaacaagatccttaatgcagagctagaggacttctggcagggaagtggggaagtgttccagatagcagggcatgaaaacttagagaggtacaagtggctgaaaatcgagtttttcctctgtctttaaattttatatgggctttgttatcttccactggaaaagtgtaatagcatacatcaatggtgtgttaaagctatttccttgccttttttttattggaatggtaggatatcttggctttgccacacacagttacagagtgaacactctactacatgtgactggcagtattaagtgtgcttattttaaatgttactggtagaaaggcagttcaggtatgtgtgtatatagtatgaatgcagtggggacaccctttgtggttacagtttgagacttccaaaggtcatccttaataacaacagatctgcaggggtatgttttaccatctgcatccagcctcctgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaatgttgaaaaaaaacccttgattatactctgttggacaaaccgagtgcaatgaatgatgcttttctgaaaatgaaatataacaagtgggtgaatgtggttatggccgaaaaggatatgcagtatgcttaatggtagcaactgaaagaagacatcctgagcagtgccagctttcttctgttgatgccgttccctgaacataggaaaatagaaacttgcttatcaaaacttagcattaccttggtgctctgtgttctctgttagctcagtgtctttccttacatcaataggtttttttttttttttttggcctgaggaagtactgaccatgcccacagccaccggctgagcaaagaagctcatttcatgtgagttctaaggaatgagaaacaattttgatgaatttaagcagaaaatgaatttctgggaacttttttgggggcgggggggtggggaattcagccacactccagaaagccaggagtcgacagttttggaagcctctctcaggattgagattctaggatgagattggcttactgctatcttgtgtcatgtacccactttttggccagactacactgggaagaaggtagtcctctaaagcaaaatctgagtgccactaaatggggagatggggctgttaagctgtccaaatcaacaagggtcatataaatggccttaaactttggggttgctttctgcaaaaagttgctgtgactcatgccatagacaaggttgagtgcctggacccaaaggcaatactgtaatgtaaagacatttatagtactaggcaaacagcaccccaggtactccaggccctcctggctggagagggctgtggcaatagaaaattagtgccaactgcagtgagtcagcctaggttaaatagagagtgtaagagtgctggacaggaacctccaccctcatgtcacatttcttcaatgtgacccttctggcccctctcctcctgacagcggaacaatgactgccccgataggtgaggctggaggaagaatcagtcctgtccttggcaagctcttcactatgacagtaaaggctctctgcctgctgccaaggcctgtgactttctaacctggcctcacgctgggtaagcttaaggtagaggtgcaggattagcaagcccacctggctaccaggccgacagctacatcctccaactgaccctgatcaacgaagagggattcatgtgtctgtctcagttggttccaaatgaaaccagggagcaggggagttaggaatcgaacaccagtcatgcctactggctctctgctcgagagccaataccctgtgccctccactcatctggatttacaggaactgtcatagtgttcagtattgggtggtgataagcccattggattgtccccttggggggatgagctaggggtgcaaggaacacctgatgagtagataagtggagctcatggtatttcctgaaagatgctaatctatttgccaaacttggtcttgaatgtactgggggcttcaaggtatgggtatatttttcttgtgtccttgcagttagcccccatgtcttatgtgtgtcctgaaaaaataagagcctgcccaagactttgggcctcttgacagaattaaccacttttatacatctgagttctcttggtaagttctttagcagtgttcaaagtctactagctcgcattagtttctgttgctgccaacagatctgaactaatgctaacagatccccctgagggattcttgatgggctgagcagctggctggagctagtactgactgacattcattgtgatgagggcagctttctggtacaggatt

SEQ ID NO: 616 - DNA, 550 bp, Homo sapiens
tgggagcgtccgggggcccatctctctcgggtggagtcttctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggcccccaataaaggcagctgcctctgctccctctgaacca

SEQ ID NO: 617 - DNA, 2635 bp, Homo sapiens
ggcagtgggcgtggcggtgctgcccaggtgagccaccgctgcttctgcccagacacggtcgcctccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaattttctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctattgacaataaaatattattgaactac

SEQ ID NO: 618 - DNA, 2589 bp, Homo sapiens
cagacacggtcgcctccacatccaggtctttgtgctcctcgcttgcctgttccttttccacgcattttccaggataacttccttgcttccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaattttctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctattgacaataaaatattattgaactac

SEQ ID NO: 619 - DNA, 2593 bp, Homo sapiens
cagacacggtcgcctccacatccaggtctttgtgctcctcgcttgcctgttccttttccacgcattttccaggataacttccttgcttccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaaggtcagatcaacaactcaattaaggatctcacagatggcaagccactttgagaacattttagctgacaacagtgtgaacgaccagaccaaaatccttgtggttaatgctgcctactttgttggcaagtggatgaagaaattttctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacatcattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctattgacaataaaatattattgaactac

SEQ ID NO: 620 - DNA, 2520 bp, Homo sapiens
agcgcggcgcgggcccaacgagcgcacgcgtacacgcgtgcgcaggggaagaccgagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggagactatggttctatccttttttcttccgacctcatttagaaaatacttatttgcaactcttagattgttttcctgatataccttttctcattaattgtctaattaactagcaaagattcctgcttaagagtgtgtgctctgcaaccaaactgcctagatttgaatcttgtctacaccacttactagctgtttaact

SEQ ID NO: 621 - DNA, 2443 bp, Homo sapiens
agcgcggcgcgggcccaacgagcgcacgcgtacacgcgtgcgcaggggaagaccgagtgccaggggctgaaccgcagggaagggggcgcggcgcacgcagtatggcgcccaacatctacttggttcgccagcggatcagtcgactcggccagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcatagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggagactatggttctatccttttttcttccgacctcatttagaaaatacttatttgcaactcttagattgttttcctgatataccttttctcattaattgtctaattaactagcaaagattcctgcttaagagtgtgtgctctgcaaccaaactgcctagatttgaatcttgtctacaccacttactagctgtttaact

SEQ ID NO: 622 - DNA, 2483 bp, Homo sapiens
cgagcccggccagcgcgccagccccgcctgcccttcctcgccaccgggctgctctggtctcgtcggtcccctcctccgccccgtcgtcctgactctctctccctcctttcctcagaggatgtccggcttccagatcaacctcaacccgctcaaggagccactcggcttcatcaaggtcctcgagtggattgcttctatctttgcttttgccacctgtggaggttttaagggccaaacagaaattcaagtgaattgtcctcctgcagttactgagaataaaactgttacagctacttttggttatccattcaggttgaatgaggcatcatttcagccacctccaggtgtaaacatatgtgatgtaaattggaaagattacgtcctcataggcgattactcttcttctgcacaattctatgttacctttgcagtctttgtgttcctgtactgcattgctgcccttctgctttatgttggctacacgagtctgtatctggatagtcgtaaacttcctatgatagactttgttgttacacttgttgccacttttttgtggttggtgagcacttcagcctgggctaaagctctgacagatattaaaatagctactggtcacaatattattgatgaacttccgccttgtaagaagaaagcagtactgtgttactttggctctgtgaccagtatgggatccctaaatgtatctgtgatatttggctttctaaatatgatactctggggaggaaatgcttggtttgtgtacaaggagaccagcctacacagtccatcaaatacatctgcccctcatagccaaggaggtattccacctcctaccggaatataattaaagggagaaatacactgtatgaagtatatgttgatactatgacatgttgccaacaccttgagaagcattatttgtttctaataaaagtaatggctttgtcaatatattggtgggtttaaaactttgctgcttttttacataaagcctgtgcctttcctagaaagttaagatgtaaatgtattctcacatgtaaatttgaaagttcaggggtctattatgaaatgatacacatttttaaatgaaccataatttttttcactaagctgtttgccttccaaagtgtttacaccttaagccttaacatgtatcttcattcagaaaacagttatattgtcataccatagtaggaagaaaaacctttatttggaatatacactactgtaagtttgtacagatcatatacctaccacctgtctttgcttaaagagccttgattacataaatatgtaggaaaaaacatattgagttcaaaatttatatctaacattgtttatgttatgatttttttttaattgcaaagactaggtgtatatttttttctgtttttctaaatgacccgtggtacttaataggtgtactaaaattgtgttgggagcagggatttggaaatttctgagagatgtgtagttaatttagtaattctgtttcatgagatatgatctgttatgctagtggtttaataggcttgctatgtaagtagaacgtggctcaactagatatctttatatgtatgggcattactcttagtgatatttgtttcctgtcctttgttgctcatgctgtttaagtgcaggctgagacccagcctctttgtaagtacagtaaaataatccaccgttttttacagaccctagtcaaagggttaaaaaaattaagattgctttccatgtttgaaatttaccattgagagtcaatgaagttgctattttgagtttagcattgatattgtgaaaataagtgcaatttggatttcatgtttcttaatattcattcttgtttcacaaatgaatgattaaggaattatgcatcataaaggaacctaagtgaggtatatgatgagtgtattgtctttgcacacacatataggtatattctgaatacaagcttattcacattttgcttcctaatctttttgttgtacagggattcaggtttcttattcttacaacatgattgtttatatgtgaagcacatcttgctgttgccttatttttgatgcttttattcatgacaagaattgtcaatataagaatgtatatcttttttgcaaccaatttaataaaggagttgaaagaaagagtgcactgattgttaatattacaaagaaaccttcatcttaaaggcattgagcagtgcaaaacagaactgattttcaaagcaggaaatagaatcacagttttaatgtttggcaaggaataaaacagacagaaatgctttggagactatggttctatccttttttcttccgacctcatttagaaaatacttatttgcaactcttagattgttttcctgatataccttttctcattaattgtctaattaactagcaaagattcctgcttaagagtgtgtgctctgcaaccaaactgcctagatttgaatcttgtctacaccacttactagctgtttaact

SEQ ID NO: 623 - DNA, 5880 bp, Homo sapiens
agacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacagtaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaa

SEQ ID NO: 624 - DNA, 5869 bp, Homo sapiens
aaacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccactttgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcgtcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctagggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcaactctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcrccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctcacactttctctgaatcatttaggtttaagatgtaagtgaacaattctttctttctgccaagaaacaaagttttggatgagcttttatatatggaacttactccaacaggactgagggaccaaggaaacatgatgggggaggcaagagagggcaaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagt

SEQ ID NO: 625 - DNA, 1260 bp, Homo sapiens
tctatgagaggccatacacggtggacctgactagggtgtggcttccctgaggagctgaagttgcccagaggcccagagaaggggagctgagcacgtttgaaccactgaacctgctctggacctcgcctccttcccttcggtgcctcccagcatcctatcctctttaaagagcaggggttcagggaagttccctggatggtgattcgcaggggcagctcccctctcacctgccgcgatgactaccccgccccatctcaaacacacaagctcacgcatgcgggactggagcccttgaggacatgtggcccaaagacaggaggtacaggggctcagtgcgtgcagtggaatgaactgggcttcatctctggaagggtaaggggccatcttccgggttcaccgccgcatccccacccccggcacagcgcctcctggcgactaacatcggtgacttagtgaaaggactaagaaagacccgaggcgaggccggaacaggccgatttctagccgccaagtggagaacaggttggagcggtgcgccgggcttagcggcggttgctggaggaacgggcggagtcgcccagggtcctgccctgcgggggtcgagccgaggcaggcggtgacttccccactcggggcggagccgcagcctcgcgggggcggggcctggcgccggcggtggcgtcacaaaaggcgggaccacagtggtgtccgagaagtcaggcacgtagctcagcggcggccgcggcgcgtgcgtctgtgcctctgcgcgggtctcctggtccttctgccatcatgccgatgttcatcgtaaacaccaacgtgccccgcgcctccgtgccggacgggttcctctccgagctcacccagcagctggcgcaggccaccggcaagcccccccagtacatcgcggtgcacgtggtcccggaccagctcatggccttcggcggctccagcgagccgtgcgcgctctgcagcctgcacagcatcggcaagatcggcggcgcgcagaaccgctcctacagcaagctgctgtgcggcctgctggccgagcgcctgcgcatcagcccggacagggtctacatcaactattacgacatgaacgcggccaatgtgggctggaacaactccaccttcgcctaagagccgcagggacccacgctgtctgcgctggctccacccgggaacccgccgcacgctgtgttctaggcccgcccaccccaaccttctggtggggagaaataaacggtttagagactagga

SEQ ID NO: 626 - DNA, 4103 bp, Homo sapiens
ctcacagcccgaaactgcaaggagctcctctgcccggcctctctttactcctcctctctgcccctcagctcgctcatctttcttcccgccccctctcttttccttctttggttctttgaagtgatgagctagcgcaaccacaaaccatacattccttttgtagaaaaacccgtgcctcgaatgaggcgagactcagagaggacccaggcgcggggcggacccctccaattccttcctcgcgcccccgaaagagcggcgcaccagcagccgaactgccggcgcccaggctccctggtccggccgggatgcggccggtacccgctccccgccgggaacaacctctccactcttcctgcagggagctggtgccagccgacagccgcgccagggccgctccgggtaccagggtcggatcgggtgacgtcgcgaacttgcgcctggccgccaagccggcctccaggctgaagaaggacccgccccggccttgacccgggccccgcccctccagccggggcaccgagccccggccctagctgctcgcccctactcgccggcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacgcggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattagctataaaaaatgtcaataagattgtacaaggaaaattagagaaaggcacatttagggtttattttttacacttggccagtaaaatagggtaaatcctattagaattttttaaagaactttttttaagtttcctaaatctgtgtgtgtattgtgaagtggtataagaaatgactttgaaccactttgcaattgtagattcccaacaataaaattgaagataa

SEQ ID NO: 627 - DNA, 3547 bp, Homo sapiens
gcactcgcccggctcgcccgctttcgcacccagttcacgcgccacagctatgtgtccccgagccgcgcgggcgcccgcgacgctactcctcgccctgggcgcggtgctgtggcctgcggctggcgcctgggagcttacgattttgcacaccaacgacgtgcacagccggctggagcagaccagcgaggactccagcaagtgcgtcaacgccagccgctgcatgggtggcgtggctcggctcttcaccaaggttcagcagatccgccgcgccgaacccaacgtgctgctgctggacgccggcgaccagtaccagggcactatctggttcaccgtgtacaagggcgccgaggtggcgcacttcatgaacgccctgcgctacgatgccatggcactgggaaatcatgaatttgataatggtgtggaaggactgatcgagccactcctcaaagaggccaaatttccaattctgagtgcaaacattaaagcaaaggggccactagcatctcaaatatcaggactttatttgccatataaagttcttcctgttggtgatgaagttgtgggaatcgttggatacacttccaaagaaaccccttttctctcaaatccagggacaaatttagtgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttctttacacaggcaatccaccttccaaagaggtgcctgctgggaagtacccattcatagtcacttctgatgatgggcggaaggttcctgtagtccaggcctatgcttttggcaaatacctaggctatctgaagatcgagtttgatgaaagaggaaacgtcatctcttcccatggaaatcccattcttctaaacagcagcattcctgaagatccaagcataaaagcagacattaacaaatggaggataaaattggataattattctacccaggaattagggaaaacaattgtctatctggatggctcctctcaatcatgccgctttagagaatgcaacatgggcaacctgatttgtgatgcaatgattaacaacaacctgagacacacggatgaaatgttctggaaccacgtatccatgtgcattttaaatggaggtggtatccggtcgcccattgatgaacgcaacaatggcacaattacctgggagaacctggctgctgtattgccctttggaggcacatttgacctagtccagttaaaaggttccaccctgaagaaggcctttgagcatagcgtgcaccgctacggccagtccactggagagttcctgcaggtgggcggaatccatgtggtgtatgatctttcccgaaaacctggagacagagtagtcaaattagatgttctttgcaccaagtgtcgagtgcccagttatgaccctctcaaaatggacgaggtatataaggtgatcctcccaaacttcctggccaatggtggagatgggttccagatgataaaagatgaattattaagacatgactctggtgaccaagatatcaacgtggtttctacatatatctccaaaatgaaagtaatttatccagcagttgaaggtcggatcaagttttccacaggaagtcactgccatggaagcttttctttaatatttctttcactttgggcagtgatctttgttttataccaatagccaaaaattctccttgcctttaatgtgtgaaactgcattttttcaagtgagattcaaatctgccttttaggacctggctttgtgacagcaaaaaccatctttacaggctcctagaagctgaaggttagagcattataaaatgaagagacagacatgattactcagggtcagcaacctagtgagttagaaaaaaaattaacatagggccctataaggagaaagccaactatgttaagtttacgtgtccaaattttaatgaaattttactaacaattttaaaccatatttttcttcttcatatccatttctaatccatcaaacagcttatgtttacataaaattttatcattcacaaggaagttttaagcacactgtctcatttgatatccacaacttatttttggtaggaaagagagatgtttttcccacctgtcagatgaaaaaactgaagctcaaaaagggttgacttgaccatacagctaatgctgacagatccaagacctagacctaggtcttttgaactcaagtccagcattctcaactatatcaagttactgttcagaatacttaatatctcctctcttcataattatcaatagccccaagctcatggatgacaaatctctgctttatttcttgtctctattttttcactttatagctcctgttataatagcaagtttaatggtataaacacaggataccatcctctcttgcaacacccatgtgcctttgatgagtcaggtagcaagctgtagtagataatgagaaaggccagaggctgcaaagacagtcaaaggacacgagagaaaggaaggggaagaacaggactccaggactgttttatattatagaaaagcaagagctaaagagcatttacacatgttaaacagatacttgttaagcatagtgcctgacacacggcattagctgttattttatgagattccatcagctctgcctctgtcctctttcttctaacatgaaggtatcatgagaagagaaccttctaacataagctgtaattctaaacctgcacttgtccctctccagcaagaggctagcactgaattcattctactcatactacacacccagttatggaatgtccagagttctcgaagaaaataaatgactttaggaagaggtatacattttttaagtcgctctgcctccaaatctgaacagtcactgtaaatcattcttaagcccagatatgagaacttctgctggaaagtgggaccctctgagtgggtggtcagaaaatacccatgctgatgaaatgacctatgcccaaagaacaaatacttaacgtgggagtggaaccacatgagcctgctcagctctgcataagtaattcaagaaatgggaggcttcaccttaaaaacagtgtgcaaatggcagctagaggttttgataggaagtatgtttgtttcttagtgtttacaaatattaagtactcttgatacaaaatatacttttaaacttcataacctttttataaaagttgttgcagcaaaataatagcctcggttctatgcatatatggattgctataaaaaatgtcaataagattgtacaaggaaaattagagaaagtcacatttagggtttattttttacacttggccagtaaaatagggtaaatcctattagaaattttttaaagaactttttttaagtttcctaaatctgtgtgtgtattgtgaagtggtataagaaatgactttgaaccactttgcaattgtagattcccaacaataaaattgaagat

SEQ ID NO: 628 - DNA, 1635 bp, Homo sapiens
aaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggtatagcgccagaggggggccccaggcgccccgaggtcttgcccttgcggctttccctttgcgggggtgggcgccttcttccgggtaggggccacgtggccctggccgggcggggggctcggcccaccccgcgccgggcccagtgactcaggccgcagctgttaccgcgtcacatgagggaggccggcggccactcggcgggggaggggaccgtggctggagcccggggcggggccgcgcggcaggcggggcgggagccggggggcgcagctagagagccccggagccgcggcgggagaggaacgcgcagccagccttgggaagcccaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttgggggg

SEQ ID NO: 629 - DNA, 1357 bp, Homo sapiens
gtggcttcggggaagggcttcctccccttttctcagactaggatccctggaaaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttcaattaaacggattattttttcagaccgaaaagagatggtctgagtttgtcttagagtgatgcttgattccttcctttccttactgatgttccctgtcctctgggaccttaatgcatgtgtacttcgaggtctattttgggggg

SEQ ID NO: 630 - DNA, 1670 bp, Homo sapiens
gtggcttcggggaagggcttcctccccttttctcagactaggatccctggaaaatggagaagctgtgctaatagaggggggccagaaatccccactctagaatgctgtagaatgttgggagacacccaggatgtgagccagggactttctggaagtgtttgttctggccccacccgaccccaggcagtccccagctgtctgcacagtcggatggggagggggcttgcacagagttggagccagaggagagagctggctcatcccctacggtaggatggggaaacctcacagaccacattgtcacccggcctcagctctccgccccggcgctcagagggtaactctcacccacctcgtccgcttctctgaaccagagtgacccaggctgcgctccgccccgctctcctaccccgagttggcacggaggcccggcagccatggcggtggaaggaggaatgaaatgtgtgaagttcttgctctacgtcctcctgctggccttttgcgcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgttggtggaggtggccgcagccattgctggctatgtgtttagagataaggtgatgtcagagtttaataacaacttccggcagcagatggagaattacccgaaaaacaaccacactgcttcgatcctggacaggatgcaggcagattttaagtgctgtggggctgctaactacacagattgggagaaaatcccttccatgtcgaagaaccgagtccccgactcctgctgcattaatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatatcagtgtccttagcaggagaatttatgtgaatattgccttttcttccatggaagccacccagcctggcccagaaccctcatcacctgctcttctcccccaagaaatatgaagaccattcccagtacagacactgaattgcaaccttactccccttcagaaaataagggaaatgtattaaagtgccctttgatggccactccccgacgtgcagctgtagatgtgaggcagttccctggcgccccactgtgggtgctagctgttttgcagggactgaacaggccagagaccgtgagcatgtcggtttggagtagttggcacttaaatggggtcagccttccactgggcacatttctgcccaccttctttttattttttaaacaatacacttttgttagtgcttattttgtggcaggcaccaggcagtaccagggtgggggcagaaataaatcaaagtccttgtccttgaaaaacaa

SEQ ID NO: 631 - DNA, 4639 bp, Homo sapiens
gcttagactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccaagtgaaatatgttgcggtagagatggaatgtataaaatccgccagtagtgtg

SEQ ID NO: 632 - DNA, 4671 bp, Homo sapiens
gcttagactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtttgaattttctttctctgactctcatccctattttacctatttccattttcgtctatcccatctatgaggtgatgatgggacttttcattgtcacgtcagctgctgtgttaacagcagtgtgtgtgaagtgaacctctacctgaccatgaagaggcaagagcacagacttacaaggatttcaacttaagcttgacttggggtttgtagcgggacccagtcaaaccccattcaggtcatggtagaatctactccttggtagtcacttgtcatttttaaagaaatgatgacaatcctcttggcatcaccccaccccacattctccccgatgttcctctcctgaattctggattttgtcctacaagtctgtgccatttataagctaagttgagggttcagagggagacaaatatccccgattgtttttcaatttttcccactttgaaaacttacacctaaaggcctgtaggcctctaactctttctgccctttcattcaaacc

SEQ ID NO: 633 - DNA, 4350 bp, Homo sapiens
gcttagactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatgtagcagttgcaccagtcaaatcttcccccaccacttctgttcctgctgtttcatctcctcctatgggcaatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtt

SEQ ID NO: 634 - DNA, 4280 bp, Homo sapiens
gcttagactgggtacctcttgcccttgcagatgctggatacttatggctgctctaatggtttctttttgtctatctttgaacctttattccagagatccagttgtcatcggtatccaggaagctctcctcttcctcctcctgacgtctactactacagttgctggttgttgctaaggttgctgccatggtaacatgcacatcctgtttacaccttcatctgggcaagttggtctaagctaggaacctacctaccctggacaactactatcatcaccacctggggacaccaatcatcgtgacacggagtccaccttccactcagttcccccatcctcttcctcctctcgctgccagacttcatacggaagaaaggatctagacttcggacggctactcgggagcttattgcacaagatatattcaatctattccctcactgggcccccagagaagcaagaagtaggaagaagttgagacagggaggcaggagacactggtcagttgaagggaaacgctacatcttctctggttgaggggcttggtaacagcaggcaaaatgacgaacccatcagaccgtgtcttgcctgccaactcgatggccgagagccgtgaaggggactttggctgcacagtaatggaactgaggaagctcatggagctgcgttcgagggatgcactgacccagattaatgtccactatggaggtgtacagaatctctgcagtagactgaaaacctcccctgtggaaggtctgtctgggaaccctgcagatctggagaaacgtaggcaggtgtttggacacaacgtgatcccccccaaaaagcccaagactttcttagaattagtgtgggaagctcttcaagatgtcacgcttatcatcctggagattgcagccatcatctccctggtcctgtccttttatcgccctgctggtgaagaaaatgaactgtgtggtcaagtcgcaactaccccagaagatgaaaatgaggcacaagctggctggattgagggggcagccatccttttctcagtgatcatcgtggtgttagtgactgcctttaatgattggagcaaagagaagcaattccgggggctgcagtgccgcattgaacaggagcaaaagttctccatcatccgaaacggtcaactcatccagctccctgtggctgagattgtggttggtgatattgcccaagtcaaatacggtgatctgctgcctgcagatggaatcctgatccaagggaatgatctgaagattgatgagagctctctgacaggggaatctgaccatgtcaagaagtccctggacaaagaccccatgttgctctcagggacccatgtcatggaaggttctggccggatggtggtgacagctgttggtgtcaactctcagactggaatcatccttactctcttgggggtcaatgaggatgacgaaggggagaaaaagaagaaaggtaaaaaacaaggagtccctgaaaatcgcaacaaagcaaagacccaagacggagtggccctggaaatccagccactcaacagccaggagggaatcgacaatgaggaaaaggacaagaaggcagtcaaggtgcctaaaaaggagaagtcagtgctgcagggcaagctgactcgcctggctgttcagattgggaaagccggtctgctcatgtctgctctcacggttttcatcctgattctatactttgtgattgacaactttgtgataaatcgcagaccatggctccctgagtgtactcccatctacatccagtactttgtcaagttcttcatcatcggcatcactgtactggtggtggctgtgccagaggggctgcctctggctgtcaccatctcactggcctactctgtgaagaaaatgatgaaagacaataacctagtacggcacttggatgcttgtgagaccatgggcaacgccaccgccatctgctctgataagacaggcacgttgaccatgaaccgcatgactgtggtacaagcttatattgggggcatccattaccgtcaaatcccaagccctgatgtcttcctgcccaaagtcctggacctcattgtcaatggcatttctatcaacagtgcttatacctccaagattctgcctccagagaaggagggaggcctgcctcggcaggtgggcaacaagaccgagtgtgctctgctaggctttgtcacagatctgaagcaggattatcaggctgtgcgtaatgaagtgcccgaggagaagctctacaaggtgtacacctttaactcagtgcgcaagtcaatgagcaccgtcatcaggaatcccaacggtggcttccgtatgtacagcaagggcgcctctgagatcatcttgcgcaagtgtaatcgaatcctggaccggaaaggggaagcagtgccattcaagaataaagacagagatgatatggtacgcactgtcatcgagcccatggcctgtgatggactccggactatctgcatagcttaccgggacttcgatgacacagagccctcttgggacaatgagaatgagatcctcaccgaactgacctgtatcgcggtggtgggcattgaggaccctgtgcgcccagaggtgccagatgctattgccaaatgcaaacaagctggcattactgtcagaatggtgacaggtgacaacatcaacacagcccgggccattgccaccaaatgtggcattctgacacctggggatgacttcctgtgcttagaaggcaaagaattcaaccggctcatccgcaacgagaaaggcgaggtagagcaagaaaagctggacaagatctggcctaagcttcgggtcctggcgcgatcttctcccactgacaagcacaccctggtgaaaggcataattgacagcactgttggggaacaccggcaggtcgtggctgtcactggtgatggcacaaatgacgggcctgctctgaagaaagcggatgttggttttgccatgggcatcgcaggcacagatgtagcaaaggaggcttcagacatcatcctaacagatgacaacttcaccagcattgtgaaggcagtgatgtggggacgaaatgtctatgacagcatctccaagttcctgcagttccagctcactgtcaatgtggtggccgtgattgtagccttcactggagcctgtatcactcaggattccccattgaaagctgtgcagatgttgtgggttaatctgatcatggacacttttgcttcattggccctggccacagagccccctacggaatctctgttgaagcggcgcccctatggccgaaataagcctctgatctcacgcactatgatgaagaacatcttgggccatgcattctatcagctcattgtcatctttatccttgtctttgcgggtgagaaattctttgatattgatagtgggaggaaggcacctctacattcaccacccagccagcactataccattgtttttaacaccttcgtgctgatgcagctcttcaatgaaatcaactcccgaaagatccatggagagaagaacgtcttttcaggcatctaccgcaacattatcttctgctctgtagtcttgggcacattcatctgccagattttcatcgtggaatttgggggtaaacccttcagttgtacaagcctcagcctgtctcagtggctgtggtgtctcttcattgggattggagaacttctgtggggccagttcatctccgcaatacctacccgatccctgaagttcctgaaggaggctgggcatggcaccaccaaagaggagatcaccaaggatgccgagggactggatgagattgaccatgctgagatggagctgcgccgaggccagatcctctggttccggggcctgaaccgtatccagactcagatcgacgtaattaacacattccagacgggagcctcttttaagggagtcctaaggcgacagaacatgggtcaacaccttgatgtaaaacttgttcctagttcatcctatatcaaagtggtcaaagcgttccatagttccctccacgaaagcattcagaaaccctacaaccaaaagtccatccacagcttcatgacccaccctgaattcgccatagaggaggagttgccacgaacaccactcctggatgaggaagaggaggaaaatcctgacaaggcttctaagtttgggactagggtgctcctgttggatggtgaggtcactccatatgccaatacaaacaacaatgcggtggattgcaaccaagtgcagctcccccagtcggacagctctctacagagcctagagacatcagtt

SEQ ID NO: 635 - DNA, 4384 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggggacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgc

SEQ ID NO: 636 - DNA, 4426 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggggacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatggaggtagtgagtaccttcaagagaagcggttcagttcagggtgctgtgcgccggcggtcttcggtcctcagccagcttcatgacgtaaccaatctttctacccctactcacgcaattctctctgctgccaatcctaccagtgctgctgggaatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgc

SEQ ID NO: 637 - DNA, 4272 bp, Homo sapiens
gtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggcctggcggacaacaccaatgacctggagaagcgcaggcagatctacgggcagaacttcatccccccaaagcaacccaagaccttcctgcagctggtgtgggaggccctgcaggacgtgaccctcatcatcctggaggtggctgccatcgtctctctgggcctctcgttctatgcgccgccaggagaggagagtgaagcctgtgggaatgtgtcgggaggcgcagaagatgagggcgaggccgaagctggctggatcgagggggctgccatcctgctgtccgtcatctgtgtggtgctggtcacggccttcaatgactggagcaaggagaagcagttccgaggcctgcagagccgaattgagcaggagcagaagttcacggtcatccggaacgggcagctcctccaggtccccgtggctgcgctggtggtgggggacattgcccaggtcaagtacggcgacctgctgccagccgacggcgtgctcatccaggccaatgacctcaagatcgacgagagctccctgacgggcgagtctgaccacgtgcgcaagtcagctgacaaagatcccatgctgctctcaggcactcatgtcatggaaggttctggaagaatggtggtgaccgccgttggcgtgaattcccagacaggcatcatcttcacgctgcttggagctggcggagaggaggaagagaagaaagataagaaaggcaagcagcaggatggggccatggagagtagccagaccaaagctaagaagcaggatggtgcagtggccatggagatgcagcccctgaagagcgcggagggtggggagatggaggagcgggagaagaagaaagccaacgcacccaaaaaggagaagtctgtccttcaggggaagctcacaaagctagccgtgcagatcgggaaagcagggctggtgatgtctgccatcaccgtcatcatcctggtcctctactttgtgattgagacgtttgtcgtggaaggccggacatggctggcagagtgcacgccggtctatgtacaatacttcgtgaagttcttcatcattggtgtcactgtgctggtcgtggctgtcccagagggcctgcctcttgctgtcaccatctccttagcttactctgtcaagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggggacacccactacaaagagattccggcccccagcgccctgacccctaagatcctcgacctcctggtccatgccatctccatcaacagtgcctataccaccaaaatactacctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgcaccaacatcttgaacagcaatggcgaactccggggctttcggcctcgggaccgggacgacatggtgaggaagatcatcgagccgatggcttgcgatggcctccgcaccatctgcatcgcctaccgggacttctctgcaggccaggagcccgactgggacaacgagaatgaggtcgtgggtgacctcacctgcatagctgtcgtgggcattgaggaccctgtgcggcccgaggtccctgaagctatccgaaaatgccagcgtgctggcatcacagtccgcatggtgactggggacaacatcaacacggcccgggccatcgcagccaaatgcggcatcatccagcccggggaggacttcctgtgcctagaagggaaggagttcaaccggcggatccgcaatgagaaaggcgagatagaacaggagcggctggacaaggtgtggcccaagctgagggtgctggcccggtcgtctcccaccgacaagcacacactggtcaaagggattatcgacagcaccactggtgagcagcggcaggtggtggctgtgacaggggatggcaccaacgatgggccggccctcaagaaggcggacgtgggcttcgccatgggcatcgcagggaccgacgtggccaaggaggcctccgacatcatcctgaccgatgacaacttcaccagcatcgtcaaggcagtcatgtggggccgtaacgtctatgacagcatctccaagttcctgcagtttcaactgacggtcaatgtggtggctgtgatcgtggccttcacaggtgcctgcattactcaggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaacattctgggccacgccgtgtaccagctcgccatcatcttcaccctgctgtttgtcggggagctcttcttcgacatcgacagcgggaggaatgcgcccctgcactcgccaccctcagagcactacaccatcatcttcaacacgttcgtcatgatgcagctctttaacgagatcaacgcccgcaagatccacggcgagaggaacgtgttcgacggcatcttcagcaaccccatcttctgcaccatcgttttgggcactttcgggattcagattgtcatcgtccagtttggcgggaagcccttcagctgctccccactatccacagaacagtggctctggtgcctgtttgttggtgttggggagctggtctggggacaggtcattgccaccatccccaccagccagctcaagtgcctgaaggaagccgggcacgggcccgggaaggacgagatgaccgacgaggagctggccgaaggcgaggaagagatcgaccatgccgagcgggagctccgcaggggccagatcctctggttccggggcctgaaccggattcagacgcagatccgggtggtgaaagcgttccgtagctcgctctatgaaggcctggagaaaccagaatccaagacctccattcacaacttcatggccacgcccgagtttctgatcaatgactacacccacaacatcccgctcattgacgacacggacgtggacgagaacgaggagcgcctccgggcccccccgcccccgtcccccaaccagaacaacaacgccatagacagcggcatctacctgaccacgcatgtcaccaagtcagctacctcttcagtgttttcctccagtcccgggagcccgctccacagcgtggagacgtccctctaacaagaacttgtctcagcacatgcgcacacgcacactcggactcacacgaagtcacacgcacacatgcacgcacacacacatatggggacctgcacacctgcaaaacgagggaacaactaaggtggctgaagacctttctggcagggcatttgcaaggacccaaatccattcaacaagggtgcagcctgccacaggctcctcatccggactgaggaagacgaggacagggaggaggaaaaggaggaagaggaggacaaaaagggggaggagaaggttcttcgtccaaaggaggaaggagaagaagtagaaagtgcgaagagctgagttccccacctttttttctattgatgcttcttttttaacaaactacagttttaccgtgtgtttgccatttgagctgtgtggtgggcagggggctggtttgggtttatggggagcttttgttgcacccatgcaggggcaatcagatcagcatcttcatgc

SEQ ID NO: 638 - DNA, 5390 bp, Homo sapiens
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcagttccggtgtctcgcccggtcctcaccctcagggctcccgggacccatgctgcggtgggggacctgctggagcttcactgtgaggccctgagaggctctcccctgatcctgtaccggttttttcatgaggatgtcaccctaggaaataggtcgtccccctctggaggagcgtccttaaacctctctctgactgcagagcactctggaaactactcctgtgaggccgacaatggcctcggggcccagcgcagtgagacagtgacactttatatcacagggctgaccgcgaacagaagtggcccttttgccacaggagtcgccgggggcctgctcagcatagcaggccttgctgcgggggcactgctgctctactgctggctctcgagaaaagcagggagaaagcctgcctctgaccccgccaggagcccttcagactcggactcccaagagcccacctatcacaatgtaccagcctgggaagagctgcaaccagtgtacactaatgcaaatcctagaggagaaaatgtggtttactcagaagtacggatcatccaagagaaaaagaaacatgcagtggcctctgaccccaggcatctcaggaacaagggttcccctatcatctactctgaagttaaggtggcgtcaaccccggtttccggatccctgttcttggcttcctcagctcctcacagatgagtccacacgtctctccaactgctgtttcagcctctgcaccccaaagttccccttgggggagaagcagcattgaagtgggaagatttaggctgccccagaccatatctactggcctttgtttcacatgtcctcattctcagtctgaccagaatgcagggccctgctggactgtcacctgtttcccagttaaagccctgactggcaggttttttaatccagtggcaaggtgctcccactccagggcccagcacatctcctggattccttagtgggcttcagctgtggttgctgttctgagtactgctctcatcacacccccacagagggggtcttaccacacaaagggagagtgggccttcaggagatgccgggctggcctaacagctcaggtgctcctaaactccgacacagagttcctgctttgggtggatgcatttctcaattgtcatcagcctggtggggctactgcagtgtgctgccaaatgggacagcacacagcctgtgcacatgggacatgtgatgggtctccccacgggggctgcatttcacactcctccacctgtctcaaactctaaggtcggcacttgacaccaaggtaacttctctcctgctcatgtgtcagtgtctacctgcccaagtaagtggctttcatacaccaagtcccaagttcttcccatcctaacagaagtaacccagcaagtcaaggccaggaggaccaggggtgcagacagaacacatactggaacacaggaggtgctcaattactatttgactgactgactgaatgaatgaatgaatgaggaagaaaactgtgggtaatcaaactggcataaaatccagtgcactccctaggaaatccgggaggtattctggcttccctaagaaacaatggaagagaaggagcttggatgaggaaactgttcagcaagaggaagggcttctcacactttcatgtgcttgtggatcacctgaggatcctgtgaaaatacagatactgattcagtgggtctgcgtagagcctgagactgccattctaacatgttcccaggggatgctgatgctgctggccctgggactgcactgcatgcatgtgaagccctataggtctcagcagaggcccatggagagggaatgtgtggctctggctgcccagggcccaactcggttcacacggatcgtgctgctccctggccagcctttggccacagcaccaccagctgctgttgctgagagagcttcttctctgtgacatgttggctttcatcagccaccctgggaagcggaaagtagctgccactatctttgtttccccacctcaggcctcacactttcccatgaaaagggtgaatgtatataacctgagccctctccattcagagttgttctcccatctctgagcaatgggatgttctgttccgcttttatgatatccatcacatcttatcttgatctttgctcccagtggattgtacagtgatgacttttaagccccacggccctgaaataaaatccttccaagggcattggaagctcactccacctgaaccatggcttttcatgcttccaagtgtcagggccttgcccagatagacagggctggctctgctgccccaacctttcaaggaggaaaccagacacctgagacaggagcctgtatgcagcccagtgcagccttgcagaggacaaggctggaggcatttgtcatcactacagatatgcaactaaaatagacgtggagcaagagaaatgcattcccaccgaggccgcttttttaggcctagttgaaagtcaagaaggacagcagcaagcataggctcaggattaaagaaaaaaatctgctcacagtctgttctggaggtcacatcaccaacaaagctcacgccctatgcagttctgagaaggtggaggcaccaggctcaaaagaggaaatttagaatttctcattgggagagtaaggtacccccatcccagaatgataactgcacagtggcagaacaaactccaccctaatgtgggtggaccccgtccagtctgttgaaggcctgaatgtaacaaaagggcttattcttcctcaagtaagggggaactcctgctttgggctgggacataagtttttctgctttcagacgcaaactgaaaaatggctcttcttgggtcttgagcttgctggcatatggactgaaagaaactatgctattggatctcctggatctccagcttgctgactgcagatcttgagatatgtcagcctctacagtcacaagagctaattcattctaataaaccaatctttctgta

SEQ ID NO: 639 - DNA, 2449 bp, Homo sapiens
ctcgactctgaggtgcattctttttttgatgagaggcatctctaggtaccatccctgacctggtcctcatgctgccgaggctgttgctgttgatctgtgctccactctgtgaacctgccgagctgtttttgatagccagcccctcccatcccacagaggggagcccagtgaccctgacgtgtaagatgccctttctacagagttcagatgcccagttccagttctgctttttcagagacacccgggccttgggcccaggctggagcagctcccccaagctccagatcgctgccatgtggaaagaagacacagggtcatactggtgcgaggcacagacaatggcgtccaaagtcttgaggagcaggagatcccagataaatgtgcacagggtccctgtcgctgatgtgagcttggagactcagcccccaggaggacaggtgatggagggagacaggctggtcctcatctgctcagttgctatgggcacaggagacatcaccttcctttggtacaaaggggctgtaggtttaaaccttcagtcaaagacccagcgttcactgacagcagagtatgagattccttcagtgagggagagtgatgctgagcaatattactgtgtagctgaaaatggctatggtcccagccccagtgggctggtgagcatcactgtcagaatcccggtgtctcgcccaatcctcatgctcagggctcccagggcccaggctgcagtggaggatgtgctggagcttcactgtgaggccctgagaggctctcctccgatcctgtactggttttatcacgaggatatcaccctggggagcaggtcggccccctctggaggaggagcctccttcaacctttccctgactgaagaacattctggaaactactcctgtgaggccaacaatggcctgggggcccagcgcagtgaggcggtgacactcaacttcacagtgcctactggggccagaagcaatcatcttacctcaggagtcattgaggggctgctcagcacccttggtccagccaccgtggccttattattttgctacggcctcaaaagaaaaataggaagacgttcagccagggatccactcaggagccttcccagccctctaccccaagagttcacctacctcaactcacctaccccagggcagctacagcctatatatgaaaatgtgaatgttgtaagtggggatgaggtttattcactggcgtactataaccagccggagcaggaatcagtagcagcagaaaccctggggacacatatggaggacaaggtttccttagacatctattccaggctgaggaaagcaaacattacagatgtggactatgaagatgctatgtaaggttatggaagattctgctctttgaaaaccatccatgaccccaagcctcaggcctgatatgttcttcagagatcctggggcattagctttccagtatacctcttctggatgccattctccatggcactattccttcatctactgtgaagtgaagttggcgcagccctgaagaaactacctaggagaactaatagacacaggagtgacagggactttgttatcagaaccagattcctgccggctcctttgaaaacaggtcatattgtgctcttctgtttacaagaggaaacaagatggaataaaagaaattgggatcttgggttggagggacagtgaagcttagagcacatgaactcaaggttagtgactctgcaggacttcacagagagagctgtgcccatcattcagtccaagtgctttctctgcccagacagcacagaactccagccccgctacttacatggatcatcgagtttccacctaaaatatgattctatttattttgagtcactgttaccaaattagaactaaaacaaagttacataaaaagttattgtgactccacttaattttagtgacgtatttttgtatatataggccaacctataccacatccaaaattatgtatctattacagcccctagaagctttataaatacagtgtgtcttcttttattcacaaaatttttgaaatcgtggtaatatggtttgaaacctgtatcttaattattttttttttaaattgagacagggtctcactctgtcactcaatctggaatgcagtggcacaatcttgcctcactgcaacgcctgcctctcaggctcaagcaaacctctcacctcagcctgctgagtagctgggactacaggcacatgccaccaaacttggccattttttgtcttacgtagagacaagatttcaccgttttgcccaggctggtctcaaactcctgggctcaagcaatgtattgaattttaaaataaccaggcactcactcttatgaattaataaacatttggaggtatataaagtaaaaagttaaagtctttcctgtaagttaacacaaatgttaactattgttaaaaacttt

SEQ ID NO: 640 - DNA, 2862 bp, Homo sapiens
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactgttccagtgtctcgccccatcctcaccctcagggttcccagggcccaggctgtggtgggggacctgctggagcttcactgtgaggccccgagaggctctcccccaatcctgtactggttttatcatgaggatgtcaccctggggagcagctcagccccctctggaggagaagcttctttcaacctctctctgactgcagaacattctggaaactactcatgtgaggccaacaatggcctagtggcccagcacagtgacacaatatcactcagtgttatagttccagtatctcgtcccatcctcaccttcagggctcccagggcccaggctgtggtgggggacctgctggagcttcactgtgaggccctgagaggctcctccccaatcctgtactggttttatcatgaagatgtcaccctgggtaagatctcagccccctctggaggaggggcctccttcaacctctctctgactacagaacattctggaatctactcctgtgaggcagacaatggtctggaggcccagcgcagtgagatggtgacactgaaagttgcaggtgagtgggccctgcccaccagcagcacatctgagaactgactgtgcctgttctccctgcagctgaaaatggagccacagagctcctcagggctgtttgcttgtgtggcatcccagcacacttcctgcctgcagaacctccctgtgaaagtctcggatcctttgtggtatggttccaggaatctgatgtttcccagcagtcttcttgaagatgatcaaagcacctcactaaaaatgcaaataagacttttttagaacataaactatattctgaactgaaattattacatgaaaatgaaaccaaagaattctgagcatatgtttctctgccgtagaaaggattaagctgtttcttgtccggattcttctctcattgacttctaagaagcctctactcttgagtctctttcattactggggatgtaaatgttccttacatttccacattaaaaatcctatgttaaca

SEQ ID NO: 641 - DNA, 1934 bp, Homo sapiens
aattcactaatgcattctgctctttttgagagcacagcttctcagatgtgctccttggagctggtgtgcagtgtcctgactgtaagatcaagtccaaacctgttttggaattgaggaaacttctcttttgatctcagcccttggtggtccaggtcttcatgctgctgtgggtgatattactggtcctggctcctgtcagtggacagtttgcaaggacacccaggcccattattttcctccagcctccatggaccacagtcttccaaggagagagagtgaccctcacttgcaagggatttcgcttctactcaccacagaaaacaaaatggtaccatcggtaccttgggaaagaaatactaagagaaaccccagacaatatccttgaggttcaggaatctggagagtacagatgccaggcccagggctcccctctcagtagccctgtgcacttggatttttcttcagcttcgctgatcctgcaagctccactttctgtgtttgaaggagactctgtggttctgaggtgccgggcaaaggcggaagtaacactgaataatactatttacaagaatgataatgtcctggcattccttaataaaagaactgacttccatattcctcatgcatgtctcaaggacaatggtgcatatcgctgtactggatataaggaaagttgttgccctgtttcttccaatacagtcaaaatccaagtccaagagccatttacacgtccagtgctgagagccagctccttccagcccatcagcgggaacccagtgaccctgacctgtgagacccagctctctctagagaggtcagatgtcccgctccggttccgcttcttcagagatgaccagaccctgggattaggctggagtctctccccgaatttccagattactgccatgtggagtaaagattcagggttctactggtgtaaggcagcaacaatgcctcacagcgtcatatctgacagcccgagatcctggatacaggtgcagatccctgcatctcatcctgtcctcactctcagccctgaaaaggctctgaattttgagggaaccaaggtgacacttcactgtgaaacccaggaagattctctgcgcactttgtacaggttttatcatgagggtgtccccctgaggcacaagtcagtccgctgtgaaaggggagcatccatcagcttctcactgactacagagaattcagggaactactactgcacagctgacaatggccttggcgccaagcccagtaaggctgtgagcctctcagtcactgttcccgtgtctcatcctgtcctcaacctcagctctcctgaggacctgatttttgagggagccaaggtgacacttcactgtgaagcccagagaggttcactccccatcctgtaccagtttcatcatgaggatgctgccctggagcgtaggtcggccaactctgcaggaggagtggccatcagcttctctctgactgcagagcattcagggaactactactgcacagctgacaatggctttggcccccagcgcagtaaggcggtgagcctctccgtcactgtccctgtgtctcatcctgtcctcaccctcagctctgctgaggccctgacttttgaaggagccactgtgacacttcactgtgaagtccagagaggttccccacaaatcctataccagttttatcatgaggacatgcccctgtggagcagctcaacaccctctgtgggaagagtgtccttcagcttctctctgactgaaggacattcagggaattactactgcacagctgacaatggctttggtccccagcgcagtgaagtggtgagcctttttgtcactggtaagtgctgggttcttgccagtcacccacccctggctgagttctctctcacccattcctttaaaaatctgtttgcactgtccagtttcctcccc

SEQ ID NO: 642 - DNA, 4423 bp, Homo sapiens
cccccgcgttgggagagctgcccccgccccccgcgcgcccctccctcccgggcccggcgccgcccggcccagttccagcgcagctcagcccctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtccgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcgggcatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 643 - DNA, 5066 bp, Homo sapiens
gaagaacctccctctcctcaccaaccccaaactgcagtcattcaaaaactgctcccgccaactccctccaccccgagctcgcccgcttccctcccgccaaggccagccctccgcggcccccaccatcctaggcctgagaacgcggctccaacacctccactcgccccgagtttctccgcgcccgcccccgtggaccccggttcctctcccgccccagcggggccccccaggctcctcccctcccccaccttgcatccccaccctccggcccacccggccctcctcctgtgccgcgcccctgctgggcccgaaccagggcgttggcgctgcgtgccagggcctctgcctctgcgtctccccgcccactgttcacaaagtccccttcctcctccgcctcgggttccccagccccggccccctcgccccacaccacctcctgcacctcagcccggatcctcagttggctcagcagtgcccgcagccgcccctcggccgccccaggcgcctcccgaggccccaggcacaggaagatccggagccgggcgctatgccaagcgggcaccatgcccaagatggttgccatctgcagcaggaagaggccgcagacatccacatagccgggcccaccccggggccgcagcagcccccgcgttgggagagctgcccccgccccccgcgcgcccctccctcccgggcccggcgccgcccggcccagttccagcgcagctcagcccctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtccgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcgggcatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 644 - DNA, 4078 bp, Homo sapiens
ctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtccgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcgggcatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggcctcacaccctctcctggaccagcggcagcctcactactcagcttttggctctgtgggcgagtggcttcgggccatcaaaatgggaagatacgaagaaagtttcgcagccgctggctttggctccttcgagctggtcagccagatctctgctgaggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttgg

SEQ ID NO: 645 - DNA, 5199 bp, Homo sapiens
ccgaaaatggtgaccccattttaatgagggagagaccccacgataaacaaaatcgattagtaaataccaacccatgctagagagtgaagagctctggaggagaggcacgggtgcgcccctggagttgctctaaacagggtaggcagggtgctcttgtcacagagaagatgaacgaaggctcgtttgatcatttaaagcggatccagtcctgggtgggatgtaagggcacgaggcctccccagctccttcgctgggcaccctatgtggggacagggtgagttgggcgggccgctgcggttctccgagagcaccacgagggggagcccggacccctcctagcgccttccgagccctcccgcacagccttgcaagcaaaagtttttcttaaactaacaatgccagtgtaaggaggtgctcgcgcctgattggccgggggaattttgcaggtttgattccttgattggacaggaggtgttaggggtggggagagagctgatggtgggggatcccgctccctcccgcgtcagtctggccggctccgtcctcccgtaggctccgctgtagctagcaatgtgacaccaggacgcactcgctctcgcgcgctctcccaggctcgttctccctcgccctctctctctcacacacgcacgcacacacccacctctcccataaacacacacacacacatgcacacccacacccacgcgcgcccgcaccgccccacgcgcacacactcctgcccacgcccacgcagcgctccgggaagtccggtccgggcgagagcgcgaaaggataccgagaagccacccgcggagagcgcagcggcgccctgggacgcggcgctctcccggcgctgctgcctcggcttggtctcggcctgcgggccgtcggccggcgatggccctggattatctactactgctcctcctggcatccgcagtggctgcgatggaagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaaggcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccagaggttgaccactgtggaatgtactggagagactggcttctcagctgaggaatgcatttccatcagtgaagaatcaaccggacctgttgctagcaggcaatctccatttctcagtgacagaagcatgtttgagatgccgtgggaaaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagaggagagggagaaaaataaaatgaaaggaaaaaaaaaagtttgcaaattcagacaggaaacaggtgagtggtttgaattggatgcagtgtgggccatcctggaatgatactgactgattaattattcctgataacatctcaagaaaaggagaaggaaagtgtttctggagaatgttctttcacatcactggaatctgcaattcaagaagtgacaagggagaattcttgctttacctatggactggcttaagccgtgtggcatccgaggaatgtttcaaatgtgtctgtgtttctctttacattccttgttgtacctcattgttcaattcacttttgtaaattccacctaacatttaattattttaaatttctccttttaccttaatctccttgctaattttatctgtctaattaaaaagagcagaagcatgtctgggtttacgtaaaa

SEQ ID NO: 646 - DNA, 3921 bp, Homo sapiens
cagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccttccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggactttatttatttctagttctttcctccccctgcaacttccgctgaggggtctcggatgacaccctggcctgaactgaggagatgaccagggatgctgggctgggccctctttccctgcgagacgcacacagctgagcacttagcaggcaccgccacgtcccagcatccctggagcaggagccccgccacagccttcggacagacatatgggatattcccaagccgaccttccctccgccttctcccacatgaggccatctcaggagatggagggcttggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttttaaatatatattttgtactttgtggagagaatgtgtgtgtgtggcagggggccccgccagggctggggacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaaccg

SEQ ID NO: 647 - DNA, 3364 bp, Homo sapiens
cagaagttgcgcgcaggccggcgggcgggagcggacaccgaggccggcgtgcaggcgtgcgggtgtgcgggagccgggctcggggggatcggaccgagagcgagaagcgcggcatggagctccaggcagcccgcgcctgcttcgccctgctgtggggctgtgcgctggccgcggccgcggcggcgcagggcaaggaagtggtactgctggactttgctgcagctggaggggagctcggctggctcacacacccgtatggcaaagggtgggacctgatgcagaacatcatgaatgacatgccgatctacatgtactccgtgtgcaacgtgatgtctggcgaccaggacaactggctccgcaccaactgggtgtaccgaggagaggctgagcgtatcttcattgagctcaagtttactgtacgtgactgcaacagcttccctggtggcgccagctcctgcaaggagactttcaacctctactatgccgagtcggacctggactacggcaccaacttccagaagcgcctgttcaccaagattgacaccattgcgcccgatgagatcaccgtcagcagcgacttcgaggcacgccacgtgaagctgaacgtggaggagcgctccgtggggccgctcacccgcaaaggcttctacctggccttccaggatatcggtgcctgtgtggcgctgctctccgtccgtgtctactacaagaagtgccccgagctgctgcagggcctggcccacttccctgagaccatcgccggctctgatgcaccttccctggccactgtggccggcacctgtgtggaccatgccgtggtgccaccggggggtgaagagccccgtatgcactgtgcagtggatggcgagtggctggtgcccattgggcagtgcctgtgccaggcaggctacgagaaggtggaggatgcctgccaggcctgctcgcctggattttttaagtttgaggcatctgagagcccctgcttggagtgccctgagcacacgctgccatcccctgagggtgccacctcctgcgagtgtgaggaaggcttcttccgggcacctcaggacccagcgtcgatgccttgcacacgacccccttccgccccacactacctcacagccgtgggcatgggtgccaaggtggagctgcgctggacgccccctcaggacagcgggggccgcgaggacattgtctacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaaccagacagagccccccaaggtgaggctggagggccgcagcaccacctcgcttagcgtctcctggagcatccccccgccgcagcagagccgagtgtggaagtacgaggtcacttaccgcaagaagggagactccaacagctacaatgtgcgccgcaccgagggtttctccgtgaccctggacgacctggccccagacaccacctacctggtccaggtgcaggcactgacgcaggagggccagggggccggcagcaaggtgcacgaattccagacgctgtccccggagggatctggcaacttggcggtgattggcggcgtggctgtcggtgtggtcctgcttctggtgctggcaggagttggcttctttatccaccgcaggaggaagaaccagcgtgcccgccagtccccggaggacgtttacttctccaagtcagaacaactgaagcccctgaagacatacgtggacccccacacatatgaggaccccaaccaggctgtgttgaagttcactaccgagatccatccatcctgtgtcactcggcagaaggtgatcggagcaggagagtttggggaggtgtacaagggcatgctgaagacatcctcggggaagaaggaggtgccggtggccatcaagacgctgaaagccggctacacagagaagcagcgagtggacttcctcggcgaggccggcatcatgggccagttcagccaccacaacatcatccgcctagagggcgtcatctccaaatacaagcccatgatgatcatcactgagtacatggagaatggggccctggacaagttccttcgggagaaggatggcgagttcagcgtgctgcagctggtgggcatgctgcggggcatcgcagctggcatgaagtacctggccaacatgaactatgtgcaccgtgacctggctgcccgcaacatcctcgtcaacagcaacctggtctgcaaggtgtctgactttggcctgtcccgcgtgctggaggacgaccccgaggccacctacaccaccagtggcggcaagatccccatccgctggaccgccccggaggccatttcctaccggaagttcacctctgccagcgacgtgtggagctttggcattgtcatgtgggaggtgatgacctatggcgagcggccctactgggagttgtccaaccacgaggtgatgaaagccatcaatgatggcttccggctccccacacccatggactgcccctccgccatctaccagctcatgatgcagtgctggcagcaggagcgtgcccgccgccccaagttcgctgacatcgtcagcatcctggacaagctcattcgtgcccctgactccctcaagaccctggctgactttgacccccgcgtgtctatccggctccccagcacgagcggctcggagggggtgcccttccgcacggtgtccgagtggctggagtccatcaagatgcagcagtatacggagcacttcatggcggccggctacactgccatcgagaaggtggtgcagatgaccaacgacgacatcaagaggattggggtgcggctgcccggccaccagaagcgcatcgcctacagcctgctgggactcaaggaccaggtgaacactgtggggatccccatctgagcctcgacagggcctggagccccatcggccaagaatacttgaagaaacagagtggcctccctgctgtgccatgctgggccactggggaagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattc

SEQ ID NO: 648 - DNA, 4848 bp, Homo sapiens
ccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacagtatgtacacacccaagcgggctggaacccttgggcccttcactgtcggttccccaatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctttagttataat

SEQ ID NO: 649 - DNA, 6605 bp, Homo sapiens
attggagtgtggagcaagcggccggtctgcagtcggagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcgtgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagcggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacaggtaaaatgtttgaagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccaaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaattcccttgaatcagtagccaggatgactattgaggatgtgatgagtttagggatcacactggttggtcatcaaaagaaaatcatgagcagcattcagactatgagagcacaaatgctacatttacatggaactggcattcaagtgtgatatgcatttctcccttttaagggagattacagactgcaagagaacagtactggccttcagtatatgcatagaatgctgctagaagacaagtgatgtcctgggtccttccaacagtgaagagaagatttaagaagcacctatagacttgaactcctaagtgccaccagaatatataaaaagggaatttaggatccaccatcggtggccaggaaaatagcagtgacaataaacaaagtactacctgaaaaacatccaaacaccttgagctctctaacctcctttttgtcttatagactttttaaaatgtacataaagaatttaagaaagaatatatttgtcaaataaaatcatgatcttattgttaaaattaatgaaatattttccttaaatatgtgatttcagactattcctttttaaaatcatttgtgtttattcttcataaggactttgttttagaaagctgtttatagctttggacctttttagtgttaaatctgtaacattactacactgggtacctttgaaagaatctcaaatttcaaaagaaatagcatgattgaagatacatctctgttagaacattggtatcctttttgtgccattttattctgtttaatcagtgctgttttgatattgtttgctaattggcaggtagtcaagaaaatgcaagttgccaagagctctgatattttttaaaaagaatttttttgtaaagatcagacaacacactatcttttcaatgaaaaaagcaataatgatccatacatactataaggcacttttaacagattgtttatagagtgattttactagaaagaatttaataaactcgaagtttaggtttatgagtatataaacaaatgaggcacttcatctgaagaatgttggtgaaggcaagtctctgaaagcagaactatccagtgttatctaaaaattaatctgagcacatcaagattttttcattctcgtgacattaggaaatttaggataaatagttgacatatattttatatcctcttctgttgaatgcagtccaaacatgaaaggaaataattgttttatattataactctgaagcatgataaaggggcagttcacaattttcaccatttaaacacaaatttgctgcacagaatatcaccattgcagttcaaaacaaaacaaaacaaaaagtcttttgtttgtgaacactgatgcaagaaacttgttaaatgaaaggactctttaccctagaaggaagaggtgaaggatctggcttgtttttaaagctttatttattaaaccatattatttgattactgtgttagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgataatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgttttcccacatttaggaccaaagacggctatagaaaaactcaaatggattgcttcccaaacccctccccaccctttttttttggttttaaatcactgtacagtgttatttgatattttaatttattttttgattgactagaaaaatcattttaatttcactaaaatgttttttgtccctaaggaaaagtaatctgtaaaaataattttaattagcataatacagtcacctagacacttccatttgtaatctttgtaatagactgtaaatatatttttggaactataacacaatgtgcttgagggttatttttcagtgtctgcagtgtgtacaagtgtttatactaagtccagcactttacaattctaatcagtagcattggcctttgtgagaatgagtgaaagagtttgagtgagtgttcttaattccttttggattctagactcactaataatgaagttcttttcttgttcatagcttaaggtgcttattttttctattaaaattaaattaacaaaagccattctagaaatagaagacatagtatggtacatgcaaacggtgtctttcctgcttttttctagcactagatttatagttgagtagtctttcttgagtagaagggcagaataaaagtttttttgagtttttttcaaaaataactttttccttcagcaatatacctcatctgccttaaattttttacagctctttacagggaaaggggagaagggatgggaaagacacacagcacaataggaagtgtatgattacatcactatctcgtttgtaagtttcttttcctaatcaacattatgatttcgaaatacatgtatgtgaaacaaatattaagagaaaaagaattaacattgtaatgctgattgtaatactctcttccagaaagagatgagatggtataacgataagaatgtacaacttgcaccttgaaatctttttttttaaataaattagtgctcaggggaggaaaagtagagaaagtgaacgtcaaaaatagaattccaaaattataaaaatgcaaaaggaaatggcctccttgctttaatagagccaccttttttagaacactgtcctcacacttgacctgtgttttgcattcagtactgaaataaaagtaacttgttctacatttgaatctaacattttctcagcaattgatctggtccttgtttactagaactggtggtttatgcttgtcagagcactattagttgaatcatattgtatacttatgtaatctacattagctagtactgtttaggactatattttaattgctcttcttatccgtgtttttaagacaattaaaatggtgtgattcacctctcttttttatttaggtaatgctgatattctcccttttgtttcttgagtagcctagaactatgctactcactgatgtgcatgttcaaataaattactgatgtgtatttttttgctatatgtggagaaatcatggggaactcggggcgagatgtgcttttcgttggttgaatttgtccctccttgcctaagaaatactacaggggtcatccttttataaggacaaactgcttttgaacagtgtcttcaatgtatcaagcacaaataactctttcttcaacatgaatcataagtctctttttaccagct

SEQ ID NO: 650 - DNA, 6335 bp, Homo sapiens
aagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgaggaaaaaaaatagattctgaaccatttattgttgaataagtagagaaaatcatcaataaatatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccct

SEQ ID NO: 651 - DNA, 6275 bp, Homo sapiens
aagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaagggagtagattctgctatcttggcctcacagcccttcctgttgattacaaagcccgtggaagaaaacagaacacaccctcctcagttccgtctaaatgtgtttcttctgcttcaattacaccagttctggggcaaagacactgatgaaacaacacccatacctgaaaagaataaatgtgtgactttcaaatcccctttcgcagtgaaagaaacagcaaacacttaagattcagcatctgttctccagttgcactgaggaatgcactgtctcgcagcaccagctctgcagagcccttgccccagactctttgcggttttatttatatgtatttccatatttcattcctgtgtgtcactgctgcattggtgtggcagcaagtgaccaaatgctacaggtcttactatggacaccaggtcaggtgcaaccacacaaaacaaagccagttccatgagctgcctatgatatgcattgcggaagtaacattttacccagggtgtgccattgcagtgatataaatatatttttttcttagactaaatatgagctgactatctcttttgatgtgtgtacataggtgtgagtgtgtctgtatgcgtgcctgtctgtgtgcgggtgtgtgtatgtgcgtagcctcatgcttaggactacccatgaatgttgtggaatgctacacctggagagttctggttttccaccagtttcaagatgaagaactacatgatacagtggacctggagaccatccccttggaaagacaacccagagatgttcagcatcctgtatctacacgcatcctgtatctacacgtgtattttgtagctgtcacactaaccttaataagaattctacagctttggacagaggcattttcaccttaatggtgaagtaatttaaaatataaatccattcaggtgacaacccatcatcaaaattacaaattttctgattgaactcatctgaatcatcagttccttgatggagagagagaaggagatggaatgtgtctggtaaccccaaatggagtacaagtagcctttgttttcctgcataaatggacttgttgaatgcgaacgaatatatgcaattcatatacttttggagatgaacgtagatatgtgtgtcagctttgagatggtgtgtcctggattaatactttgtctcccaatatcacagaaaaatacatgccagtgactcttgaggttaaggtagttgggatgaaatggcctcaggcaatttcacattccctaattacctggaaagttctacagtaattaatatgcagctaactcctgttgccctcacaagagcatcagccttctagaatcggagctccggagtgtgaagattcagtattgatatgatatgtataccaaactccagccaacttactgccatttttcataatctgagtggctgccttgcttatcctaagctgtggttgcagaaaccgtggccatttatataagctataacatcaaatcagggaaaaatgagtatttattacattctgacagggtgtgtggcattgtgttctatgccagagtgacaaagttgattcacccctttttggggaccttaatatattttttaagggatgtgcctatgcattgatgcctgaaaaatatgtataaagaaatgaggttgactcttctgagcagttcatcttttccagaggtaagggtaggaggccaacttcagggtctgggtctgagcccgtgggcaagccctggccgagtgagctccaatgctaactcatgtgccgatctctagagcagtgggaaactaccccgctgcaccaaatcaagtagcttcaccttgtgtatgcaggccccaagttattttttagcaatcttacgagtgaaatgttctggtgggttgaaaaacgttcttattttaaagaaaggttgtgctcgctacactgctggtgtgtgcattctgagacctcttgtattcaatctgtgaaggatatgtgtattaatccgtacacccgtatagcctcaatatttgtctgaagacacttaaattctgacccataaaggaaagttctagaagcaatattttcacttatttaacattctccaaacaacatcaagcattgatacacactgaagagtgcgtttattttttgtatcactctaagtatgttggaatatgcaaggactgtggttcaaattagaatgtataaggcatattataatttagttcatactgaataagaaattaacagaacattgttcggttcacacgttccaaactttgagtgatttctggagttagacatagattttctattttgttttaatttgtcaaggtatttttcttcccttcatgaactttaggtacacataacttatgtcatttatttatggtcttttatacctagtttgtaaaattgtaaaatagcaaactaaatgcaaagagtttgcatttgaaaataataaagtagttgccgtatacaaccc

SEQ ID NO: 652 - DNA, 3813 bp, Homo sapiens
aagcggcaggagcagcgttggcaccggcgaaccatggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctgagccagtactgaataaactcaaaactcttgaaattagtttacctcatccatgcactttaattgaagaactgcactttttttacttcgtcttcgccctctgaaattaaagaaatgaaaaaaaaaaacaatatctgcagcgttgcttggtgcacagattgctgaaactgtggggcttacagaaatgactgccggtcatttgaatgagacctggaacaaatcgtttctcagaagtacttttctgttcatcaccagtctgtaaaatacatgtacctatagaaatagaacactgcctctgagttttgatgctgtatttgctgccagacactgagcttctgagacatccctgattctctctccatttggaattacaaccattgtattttgtttgtggcataaattacagtcatctgtctttcactggaatgaagaccatgcctaggaacattttttaaggactcagctgtggcttttagggcttggttcataccatgggggaaaaaaaagtcctaggagaaagcgacgtggctcattagtgttgcctcttcagtgctcaagccgcctggtggattcctatgacacagggggcctggaaagaaagggaaagtggatttaaaatatatatatacgtaacccaagccccataacccctaactggacaaatgaggtctgtttctttgggcctgaggctgtgccatataaagtcttattttgggactttacaaacttgtcctaactatcttgtggatagtgggctgtgacaatctggaatagagaacgttcacacttcgctcctttaaagaagcgaccccagatctgcaag

SEQ ID NO: 653 - DNA, 3774 bp, Homo sapiens
atggccagagcccgcccgccgccgccgccgtcgacgacgccggggcttctgccgctgctccctccgctgctgctgctgacgtatttggaagaaccagtttgctcagcactgccctagaccctcatggacacaaaatgggtaacatctgagttggcgtggacgtctcatccagaaagtgggtgggaagaggtgagtggctacgatgaggccatgaatcccatccgcacataccaggtatgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgcaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatga

SEQ ID NO: 654 - DNA, 4222 bp, Homo sapiens
tgagcggcgcagcaagatcccagctcggaccccggacggcgcgcgcccccgaagccccggatcccagtcgggcccgcagctgaccgccagattactgtgcatcccgaatcacgaccacctgcaccctcctgccccggcccgccccccaagtcctcaggcacccagctccccggcgccccggatcctcctggaccggtccgtccagattcccgcgggaccgacctgtccgcatccccaggaccgccgggctcggtgcaccgcctcggtcccggagccgcccgcctggattgcattccctcctctcctggatctcctgggacccgacgcgagcctgccccggagcccgccgagcgcaccctctctcgggtgcctgcagccccgccggcgcggcccggcccggcgcggcccggctcggctcctagagctgccacggccatggccagagcccgcccgccgccgccgccgtcgacgacgccggggcttctgccgctgctccctccgctgctgctgctccacagctgctgctgctgccactgcagcttcagcggctgctgcgagctgaaagaccctcatggacacaaaatgggtaacatctgagttggcgtggacgtctcatccagaaagtgggtgggaagaggtgagtggctacgatgaggccatgaatcccatccgcacataccaggtatgtaatgtgcgcgagtcaagccagaacaactggcttcgcacggggttcatctggcggcgggatgtgcagcgggtctacgtggagctcaagttcactgtgcgtgactgcaacagcatccccaacatccccggctcctgcaaggagaccttcaacctcttctactacgaggctgacagcgatgtggcctcagcctcctcccccttctggatggagaacccctacgtgaaagtggacaccattgcacccgatgagagcttctcgcggctggatgccggccgtgtcaacaccaaggtgcgcagctttgggccactttccaaggctggcttctacctggccttccaggaccagggcgcctgcatgtcgctcatctccgtgcgcgccttctacaagaagtgtgcatccaccaccgcaggcttcgcactcttccccgagaccctcactggggcggagcccacctcgctggtcattgctcctggcacctgcatccctaacgccgtggaggtgtcggtgccactcaagctctactgcaacggcgatggggagtggatggtgcctgtgggtgcctgcacctgtgccaccggccatgagccagctgccaaggagtcccagtgccgcccctgtccccctgggagctacaaggcgaagcagggagaggggccctgcctcccatgtccccccaacagccgtaccacctccccagccgccagcatctgcacctgccacaataacttctaccgtgcagactcggactctgcggacagtgcctgcaccaccgtgccatctccaccccgaggtgtgatctccaatgtgaatgaaacctcactgatcctcgagtggagtgagccccgggacctgggtggccgggatgacctcctgtacaatgtcatctgcaagaagtgccatggggctggaggggcctcagcctgctcacgctgtgatgacaacgtggagtttgtgcctcggcagctgggcctgacggagcgccgggtccacatcagccatctgctggcccacacgcgctacacctttgaggtgcaggcggtcaacggtgtctcgggcaagagccctctgccgcctcgttatgcggccgtgaatatcaccacaaaccaggctgccccgtctgaagtgcccacactacgcctgcacagcagctcaggcagcagcctcaccctatcctgggcacccccagagcggcccaacggagtcatcctggactacgagatgaagtactttgagaagagcgagggcatcgcctccacagtgaccagccagatgaactccgtgcagctggacgggcttcggcctgacgcccgctatgtggtccaggtccgtgcccgcacagtagctggctatgggcagtacagccgccctgccgagtttgagaccacaagtgagagaggctctggggcccagcagctccaggagcagcttcccctcatcgtgggctccgctacagctgggcttgtcttcgtggtggctgtcgtggtcatcgctatcgtctgcctcaggaagcagcgacacggctctgattcggagtacacggagaagctgcagcagtacattgctcctggaatgaaggtttatattgacccttttacctacgaggaccctaatgaggctgttcgggagtttgccaaggagatcgacgtgtcctgcgtcaagatcgaggaggtgatcggagctggggaatttggggaagtgtgccgtggtcgactgaaacagcctggccgccgagaggtgtttgtggccatcaagacgctgaaggtgggctacaccgagaggcagcggcgggacttcctaagcgaggcctccatcatgggtcagtttgatcaccccaatataatccggctcgagggcgtggtcaccaaaagtcggccagttatgatcctcactgagttcatggaaaactgcgccctggactccttcctccggctcaacgatgggcagttcacggtcatccagctggtgggcatgttgcggggcattgctgccggcatgaagtacctgtccgagatgaactatgtgcaccgcgacctggctgctcgcaacatccttgtcaacagcaacctggtctgcaaagtctcagactttggcctctcccgcttcctggaggatgacccctccgatcctacctacaccagttccctgggcgggaagatccccatccgctggactgccccagaggccatagcctatcggaagttcacttctgctagtgatgtctggagctacggaattgtcatgtgggaggtcatgagctatggagagcgaccctactgggacatgagcaaccaggatgtcatcaatgccgtggagcaggattaccggctgccaccacccatggactgtcccacagcactgcaccagctcatgctggactgctgggtgcgggaccggaacctcaggcccaaattctcccagattgtcaataccctggacaagctcatccgcaatgctgccagcctcaaggtcattgccagcgctcagtctggcatgtcacagcccctcctggaccgcacggtcccagattacacaaccttcacgacagttggtgattggctggatgccatcaagatggggcggtacaaggagagcttcgtcagtgcggggtttgcatcttttgacctggtggcccagatgacggcagaagacctgctccgtattggggtcaccctggccggccaccagaagaagatcctgagcagtatccaggacatgcggctgcagatgaaccagacgctgcctgtgcaggtctgacaccggctcccacggggaccctgaggaccgtgcagggatgccaagcagccggctggactttcggactcttggacttttggatgcctggccttaggctgtggcccagaagctggaagtttgggaaaggcccaagctgggacttctccaggcctgtgttccctccccaggaagtgcgccccaaacctcttcatattgaagatggattaggagagggggtgatgacccctccccaagcccctcagggcccagaccttcctgctctccagcaggggatccccacaacctcacacttgtctgttcttcagtgctggaggtcctggcagggtcaggctggggtaagccggggttccacagggcccagccctggcaggggtctggccccccaggtaggcggagagcagtccctccctcaggaactggaggaggggactccaggaatggggaaatgtgacaccaccatcctgaagccagcttgcacctccagtttgcacagggatttgttctgggggctgagggccctgtccccacccccgcccttggtgctgtcataaaagggcaggcaggggcaggctgaggagttgccctttgccccccagagactgactctcagagccagagatgggatgtgtgagtgtgtgtgtgtgtgtgtgcgcgcgcgcgcgcgtgtgtgtgtgcacgcactggcctgcacagagagcatgggtgagcgtgtaaaagcttggccctgtgccctacaatggggccagctgggccgacagcagaataaaggcaataagatga

SEQ ID NO: 655 - DNA, 6590 bp, Homo sapiens
attggagtgtggagcaagcggccggtctgcagtcggagacttgcaggcagcaaacacggtgcgagcgaacaggagtgggggggaaattaaaaaaagctaaacgtggagcagccgatcggggaccgagaaggggaatcgatgcaaggagcacaataaaacaaaagctacttcggaacaaacagcatttaaaaatccacgactcaagataactgaaacctaaaataaaacctgctcatgcaccatggtttttcaaactcggtacccttcatggattattttatgctacatctggctgctccgctttgcacacacaggggaggcgcaggctgcgaaggaagtactactgctggattctaaagcacaacaaacagagttggagtggatttcctctccacccaatgggtgggaagaaattagtggtttggatgagaactataccccgatacgaacataccaggtgtgccaagtcatggagcccaaccaaaacaactggctgcggactaactggatttccaaaggcaatgcacaaaggatttttgtagaattgaaattcaccctgagggattgtaacagtcttcctggagtactgggaacttgcaaggaaacatttaatttgtactattatgaaacagactatgacactggcaggaatataagagaaaacctctatgtaaaaatagacaccattgctgcagatgaaagttttacccaaggtgaccttggtgaaagaaagatgaagcttaacactgaggtgagagagattggacctttgtccaaaaagggattctatcttgcctttcaggatgtaggggcttgcatagctttggtttctgtcaaagtgtactacaagaagtgctggtccattattgagaacttagctatctttccagatacagtgactggttcagaattttcctctttagtcgaggttcgagggacatgtgtcagcagtgcagaggaagaagcggaaaacgcccccaggatgcactgcagtgcagaaggagaatggttagtgcccattggaaaatgtatctgcaaagcaggctaccagcaaaaaggagacacttgtgaaccctgtggccgtgggttctacaagtcttcctctcaagatcttcagtgctctcgttgtccaactcacagtttttctgataaagaaggctcctccagatgtgaatgtgaagatgggtattacagggctccatctgacccaccatacgttgcgtgcacaaggcctccatctgcaccacagaacctcattttcaacatcaaccaaaccacagtaagtttggaatggagtcctcctgcagacaatgggggaagaaacgatgtgacctacagaatattgtgtaagcggtgcagttgggagcagggcgaatgtgttccctgtgggagtaacattggatacatgccccagcagactggattagaggataactatgtcactgtcatggacctgctagcccacgctaattatacttttgaagttgaagctgtaaatggagtttctgacttaagccgatcccagaggctctttgctgctgtcagtatcaccactggtcaagcagctccctcgcaagtgagcggagtaatgaaggagagagtactgcagcggagtgtcgagctttcctggcaggaaccagagcatcccaatggagtcatcacagaatatgaaatcaagtattacgagaaagatcaaagggaacggacctactcaacagtaaaaaccaagtctacttcagcctccattaataatctgaaaccaggaacagtgtatgttttccagattcgggcttttactgctgctggttatggaaattacagtcccagacttgatgttgctacactagaggaagctacagctacagctgtctccagtgaacagaatcctgttattatcattgctgtggttgctgtagctgggaccatcattttggtgttcatggtctttggcttcatcattgggagaaggcactgtggttatagcaaagctgaccaagaaggcgatgaagagctttactttcattttaaatttccaggcaccaaaacctacattgaccctgaaacctatgaggacccaaatagagctgtccatcaattcgccaaggagctagatgcctcctgtattaaaattgagcgtgtgattggtgcaggagaattcggtgaagtctgcagtggccgtttgaaacttccagggaaaagagatgttgcagtagccataaaaaccctgaaagttggttacacagaaaaacaaaggagagactttttgtgtgaagcaagcatcatggggcagtttgaccacccaaatgttgtccatttggaaggggttgttacaagagggaaaccagtcatgatagtaatagagttcatggaaaatggagccctagatgcatttctcaggaaacatgatgggcaatttacagtcattcagttagtaggaatgctgagaggaattgctgctggaatgagatatttggctgatatgggatatgttcacagggaccttgcagctcgcaatattcttgtcaacagcaatctcgtttgtaaagtgtcagattttggcctgtcccgagttatagaggatgatccagaagctgtctatacaactactggtggaaaaattccagtaaggtggacagcacccgaagccatccagtaccggaaattcacatcagccagtgatgtatggagctatggaatagtcatgtgggaagttatgtcttatggagaaagaccttattgggacatgtcaaatcaagatgttataaaagcaatagaagaaggttatcgtttaccagcacccatggactgcccagctggccttcaccagctaatgttggattgttggcaaaaggagcgtgctgaaaggccaaaatttgaacagatagttggaattctagacaaaatgattcgaaacccaaatagtctgaaaactcccctgggaacttgtagtaggccaataagccctcttctggatcaaaacactcctgatttcactaccttttgttcagttggagaatggctacaagctattaagatggaaagatataaagataatttcacggcagctggctacaattcccttgaatcagtagccaggatgactattgaggatgtgatgagtttagggatcacactggttggtcatcaaaagaaaatcatgagcagcattcagactatgagagcacaaatgctacatttacatggaactggcattcaagtgtgatatgcatttctcccttttaagggagattacagactgcaagagaacagtactggccttcagtatatgcatagaatgctgctagaagacaagtgatgtcctgggtccttccaacagtgaagagaagatttaagaagcacctatagacttgaactcctaagtgccaccagaatatataaaaagggaatttaggatccaccatcggtggccaggaaaatagcagtgacaataaacaaagtactacctgaaaaacatccaaacaccttgagctctctaacctcctttttgtcttatagactttttaaaatgtacataaagaatttaagaaagaatatatttgtcaaataaaatcatgatcttattgttaaaattaatgaaatattttccttaaatatgtgatttcagactattcctttttaaaatcatttgtgtttattcttcataaggactttgttttagaaagctgtttatagctttggacctttttagtgttaaatctgtaacattactacactgggtacctttgaaagaatctcaaatttcaaaagaaatagcatgattgaagatacatctctgttagaacattggtatcctttttgtgccattttattctgtttaatcagtgctgttttgatattgtttgctaattggcaggtagtcaagaaaatgcaagttgccaagagctctgatattttttaaaaagaatttttttgtaaagatcagacaacacactatcttttcaatgaaaaaagcaataatgatccatacatactataaggcacttttaacagattgtttatagagtgattttactagaaagaatttaataaactcgaagtttaggtttatgagtatataaacaaatgaggcacttcatctgaagaatgttggtgaaggcaagtctctgaaagcagaactatccagtgttatctaaaaattaatctgagcacatcaagattttttcattctcgtgacattaggaaatttaggataaatagttgacatatattttatatcctcttctgttgaatgcagtccaaacatgaaaggaaataattgttttatattataactctgaagcatgataaaggggcagttcacaattttcaccatttaaacacaaatttgctgcacagaatatcaccattgcagttcaaaacaaaacaaaacaaaaagtcttttgtttgtgaacactgatgcaagaaacttgttaaatgaaaggactctttaccctagaaggaagaggtgaaggatctggcttgtttttaaagctttatttattaaaccatattatttgattactgtgttagaatttcataagcaataattaaatgtgtctttatagatattgcaggaatgtatacatattgtgattaatgctttcaaaacttatgaaaatcatgaactaccccagaattgaactgttgtacttccaaagagaattgggctgtttataatgattttaatagagaaagatcccagggatcggtcataattggtcttgtttgataatgtgggcatccacaaacaaacaaacaaataacagaaacaaaatctgtaaatgttcctttgtaaaacttgtaaattttatttatactgtcttgttttgtacacacatttctctgtagtgggctctgaatacattgaaaatgcactatatttttctattttacttgcagagcatcacaaaagaacaggtattttcagtgctacataatgtgttttcccacatttaggaccaaagacggctatagaaaaactcaaatggattgcttcccaaacccctccccaccctttttttttggttttaaatcactgtacagtgttatttgatattttaatttattttttgattgactagaaaaatcattttaatttcactaaaatgttttttgtccctaaggaaaagtaatctgtaaaaataattttaattagcataatacagtcacctagacacttccatttgtaatctttgtaatagactgtaaatatatttttggaactataacacaatgtgcttgagggttatttttcagtgtctgcagtgtgtacaagtgtttatactaagtccagcactttacaattctaatcagtagcattggcctttgtgagaatgagtgaaagagtttgagtgagtgttcttaattccttttggattctagactcactaataatgaagttcttttcttgttcatagcttaaggtgcttattttttctattaaaattaaattaacaaaagccattctagaaatagaagacatagtatggtacatgcaaacggtgtctttcctgcttttttctagcactagatttatagttgagtagtctttcttgagtagaagggcagaataaaagtttttttgagtttttttcaaaaataactttttccttcagcaatatacctcatctgccttaaattttttacagctctttacagggaaaggggagaagggatgggaaagacacacagcacaataggaagtgtatgattacatcactatctcgtttgtaagtttcttttcctaatcaacattatgatttcgaaatacatgtatgtgaaacaaatattaagagaaaaagaattaacattgtaatgctgattgtaatactctcttccagaaagagatgagatggtataacgataagaatgtacaacttgcaccttgaaatctttttttttaaataaattagtgctcaggggaggaaaagtagagaaagtgaacgtcaaaaatagaattccaaaattataaaaatgcaaaaggaaatggcctccttgctttaatagagccaccttttttagaacactgtcctcacacttgacctgtgttttgcattcagtactgaaataaaagtaacttgttctacatttgaatctaacattttctcagcaattgatctggtccttgtttactagaactggtggtttatgcttgtcagagcactattagttgaatcatattgtatacttatgtaatctacattagctagtactgtttaggactatattttaattgctcttcttatccgtgtttttaagacaattaaaatggtgtgattcacctctcttttttatttaggtaatgctgatattctcccttttgtttcttgagtagcctagaactatgctactcactgatgtgcatgttcaaataaattactgatgtgtatttttttgctatatgtggagaaatcatggggaactcggggcgagatgtgcttttcgttggttgaatttgtccctccttgcctaagaaatactacaggggtcatccttttataaggacaaactgcttttgaacagtgtcttcaatgtatcaagcacaaataactctttcttcaacatgaatcataagtctctttttaccagct

SEQ ID NO: 656 - DNA, 4176 bp, Homo sapiens
ctgcccggcccggcccgcccggctccgcgccgcagtctccctccctcccgctccgtccccgctcgggctcccaccatccccgcccgcgaggagagcactcggcccggcggcgcgagcagagccactccagggagggggggagaccgcgagcggccggctcagcccccgccacccggggcgggaccccgaggccccggagggaccccaactccagccacgtcttgctgcgcgcccgcccggcgcggccactgccagcacgctccgggcccgccgcccgcgcgcgcggcacagacgcggggccacacttggcgccgccgcccggtgccccgcacgctcgcatgggcccgcgctgagggccccgacgaggagtcccgcgcggagtatcggcgtccacccgcccagggagagtcagacctgggggggcgagggccccccaaactcagttcggatcctacccgagtgaggcggcgccatggagctccgggtgctgctctgctgggcttcgttggccgcagctttggaagagaccctgctgaacacaaaattggaaactgctgatctgaagtgggtgacattccctcaggtggacgggcagtgggaggaactgagcggcctggatgaggaacagcacagcgtgcgcacctacgaagtgtgtgacgtgcagcgtgccccgggccaggcccactggcttcgcacaggttgggtcccacggcggggcgccgtccacgtgtacgccacgctgcgcttcaccatgctcgagtgcctgtccctgcctcgggctgggcgctcctgcaaggagaccttcaccgtcttctactatgagagcgatgcggacacggccacggccctcacgccagcctggatggagaacccctacatcaaggtggacacggtggccgcggagcatctcacccggaagcgccctggggccgaggccaccgggaaggtgaatgtcaagacgctgcgtctgggaccgctcagcaaggctggcttctacctggccttccaggaccagggtgcctgcatggccctgctatccctgcacctcttctacaaaaagtgcgcccagctgactgtgaacctgactcgattcccggagactgtgcctcgggagctggttgtgcccgtggccggtagctgcgtggtggatgccgtccccgcccctggccccagccccagcctctactgccgtgaggatggccagtgggccgaacagccggtcacgggctgcagctgtgctccggggttcgaggcagctgaggggaacaccaagtgccgagcctgtgcccagggcaccttcaagcccctgtcaggagaagggtcctgccagccatgcccagccaatagccactctaacaccattggatcagccgtctgccagtgccgcgtcgggtacttccgggcacgcacagacccccggggtgcaccctgcaccacccctccttcggctccgcggagcgtggtttcccgcctgaacggctcctccctgcacctggaatggagtgcccccctggagtctggtggccgagaggacctcacctacgccctccgctgccgggagtgccgacccggaggctcctgtgcgccctgcgggggagacctgacttttgaccccggcccccgggacctggtggagccctgggtggtggttcgagggctacgtcctgacttcacctatacctttgaggtcactgcattgaacggggtatcctccttagccacggggcccgtcccatttgagcctgtcaatgtcaccactgaccgagaggtacctcctgcagtgtccgacatccgggtgacgcggtcctcacccagcagcttgagcctggcctgggctgttccccgggcacccagtggggctgtgctggactacgaggtcaaataccatgagaagggcgccgagggtcccagcagcgtgcggttcctgaagacgtcagaaaaccgggcagagctgcgggggctgaagcggggagccagctacctggtgcaggtacgggcgcgctctgaggccggctacgggcccttcggccaggaacatcacagccagacccaactggatgagagcgagggctggcgggagcagctggccctgattgcgggcacggcagtcgtgggtgtggtcctggtcctggtggtcattgtggtcgcagttctctgcctcaggaagcagagcaatgggagagaagcagaatattcggacaaacacggacagtatctcatcgggcatggtactaaggtctacatcgaccccttcacttatgaagaccctaatgaggctgtgagggaatttgcaaaagagatcgatgtctcctacgtcaagattgaagaggtgattggtgcaggtgagtttggcgaggtgtgccgggggcggctcaaggccccagggaagaaggagagctgtgtggcaatcaagaccctgaagggtggctacacggagcggcagcggcgtgagtttctgagcgaggcctccatcatgggccagttcgagcaccccaatatcatccgcctggagggcgtggtcaccaacagcatgcccgtcatgattctcacagagttcatggagaacggcgccctggactccttcctgcggctaaacgacggacagttcacagtcatccagctcgtgggcatgctgcggggcatcgcctcgggcatgcggtaccttgccgagatgagctacgtccaccgagacctggctgctcgcaacatcctagtcaacagcaacctcgtctgcaaagtgtctgactttggcctttcccgattcctggaggagaactcttccgatcccacctacacgagctccctgggaggaaagattcccatccgatggactgccccggaggccattgccttccggaagttcacttccgccagtgatgcctggagttacgggattgtgatgtgggaggtgatgtcatttggggagaggccgtactgggacatgagcaatcaggacgtgatcaatgccattgaacaggactaccggctgcccccgcccccagactgtcccacctccctccaccagctcatgctggactgttggcagaaagaccggaatgcccggccccgcttcccccaggtggtcagcgccctggacaagatgatccggaaccccgccagcctcaaaatcgtggcccgggagaatggcggggacctgctccgaatcggagtcactctggcgggacaccagaagaaaatcttggccagtgtccagcacatgaagtcccaggccaagccgggaaccccgggtgggacaggaggaccggccccgcagtactgacctgcaggaactccccaccccagggacaccgcctccccattttccggggcagagtggggactcacagaggcccccagccctgtgccccgctggattgcactttgagcccgtggggtgaggagttggcaatttggagagacaggatttgggggttctgccataataggaggggaaaatcaccccccagccacctcggggaactccagaccaagggtgagggcgcctttccctcaggactgggtgtgaccagaggaaaaggaagtgcccaacatctcccagcctccccaggtgcccccctcaccttgatgggtgcgttcccgcagaccaaagagagtgtgactcccttgccagctccagagtgggggggctgtcccagggggcaagaaggggtgtcagggcccagtgacaaaatcattggggtttgtagtcccaacttgctgctgtcaccaccaaactcaatcatttttttcccttgtaaatgcccctcccccagctgctgccttcatattgaaggtttttgagttttgtttttggtcttaatttttctccccgttccctttttgtttcttcgttttgtttttctaccgtccttgtcataactttgtgttggagggaacctgtttcactatggcctcctttgcccaagttgaaacaggggcccatcatcatgtctgtttccagaacagtgccttggtcatcccacatccccggaccccgcctgggacccccaagctgtgtcctatgaaggggtgtggggtgaggtagtgaaaagggcggtagttggtggtggaacccagaaacggacgccggtgcttggaggggttcttaaattatatttaaaaaagtaactttttgtataaataaaagaaaatgggacgtgtcccagctccaggggt

SEQ ID NO: 657 - DNA, 3869 bp, Homo sapiens
ttttttcacgtgtgaaaacatctattggggaaatggaaaaatcatttgacctcatattcctcatagctgacatgacaaaaccaaaatgtggtggtgagccaacttcaattttgcagaaactgacttggaaagaactgattacctgaaggaccgtgaggatcaaagttgtcccactgaccaggctgtaaactttggaactgataagtgagagagataagaaacgttaatggacaccagaacggctactgcagagctgggctggacggccaatcctgcgtccgggtgggaagaagtcagtggctacgatgaaaacctgaacaccatccgcacctaccaggtgtgcaatgtcttcgagcccaaccagaacaattggctgctcaccaccttcatcaaccggcggggggcccatcgcatctacacagagatgcgcttcactgtgagagactgcagcagcctccctaatgtcccaggatcctgcaaggagaccttcaacttgtattactatgagactgactctgtcattgccaccaagaagtcagccttctggtctgaggccccctacctcaaagtagacaccattgctgcagatgagagcttctcccaggtggactttgggggaaggctgatgaaggtaaacacagaagtcaggagctttgggcctcttactcggaatggtttttacctcgcttttcaggattatggagcctgtatgtctcttctttctgtccgtgtcttcttcaaaaagtgtcccagcattgtgcaaaattttgcagtgtttccagagactatgacaggggcagagagcacatctctggtgattgctcggggcacatgcatccccaacgcagaggaagtggacgtgcccatcaaactctactgcaacggggatggggaatggatggtgcctattgggcgatgcacctgcaagcctggctatgagcctgagaacagcgtggcatgcaaggcttgccctgcagggacattcaaggccagccaggaagctgaaggctgctcccactgcccctccaacagccgctcccctgcagaggcgtctcccatctgcacctgtcggaccggttattaccgagcggactttgaccctccagaagtggcatgcactagcgtcccatcaggtccccgcaatgttatctccatcgtcaatgagacgtccatcattctggagtggcaccctccaagggagacaggtgggcgggatgatgtgacctacaacatcatctgcaaaaagtgccgggcagaccgccggagctgctcccgctgtgacgacaatgtggagtttgtgcccaggcagctgggcctgacggagtgccgcgtctccatcagcagcctgtgggcccacaccccctacacctttgacatccaggccatcaatggagtctccagcaagagtcccttccccccacagcacgtctctgtcaacatcaccacaaaccaagccgccccctccaccgttcccatcatgcaccaagtcagtgccactatgaggagcatcaccttgtcatggccacagccggagcagcccaatggcatcatcctggactatgagatccggtactatgagaaggaacacaatgagttcaactcctccatggccaggagtcagaccaacacagcaaggattgatgggctgcggcctggcatggtatatgtggtacaggtgcgtgcccgcactgttgctggctacggcaagttcagtggcaagatgtgcttccagactctgactgacgatgattacaagtcagagctgagggagcagctgcccctgattgctggctcggcagcggccggggtcgtgttcgttgtgtccttggtggccatctctatcgtctgtagcaggaaacgggcttatagcaaagaggctgtgtacagcgataagctccagcattacagcacaggccgaggctccccagggatgaagatctacattgaccccttcacttacgaggatcccaacgaagctgtccgggagtttgccaaggagattgatgtatcttttgtgaaaattgaagaggtcatcggagcaggggagtttggagaagtgtacaaggggcgtttgaaactgccaggcaagagggaaatctacgtggccatcaagaccctgaaggcagggtactcggagaagcagcgtcgggactttctgagtgaggcgagcatcatgggccagttcgaccatcctaacatcattcgcctggagggtgtggtcaccaagagtcggcctgtcatgatcatcacagagttcatggagaatggtgcattggattctttcctcaggcaaaatgacgggcagttcaccgtgatccagcttgtgggtatgctcaggggcatcgctgctggcatgaagtacctggctgagatgaattatgtgcatcgggacctggctgctaggaacattctggtcaacagtaacctggtgtgcaaggtgtccgactttggcctctcccgctacctccaggatgacacctcagatcccacctacaccagctccttgggagggaagatccctgtgagatggacagctccagaggccatcgcctaccgcaagttcacttcagccagcgacgtttggagctatgggatcgtcatgtgggaagtcatgtcatttggagagagaccctattgggatatgtccaaccaagatgtcatcaatgccatcgagcaggactaccggctgcccccacccatggactgtccagctgctctacaccagctcatgctggactgttggcagaaggaccggaacagccggccccggtttgcggagattgtcaacaccctagataagatgatccggaacccggcaagtctcaagactgtggcaaccatcaccgccgtgccttcccagcccctgctcgaccgctccatcccagacttcacggcctttaccaccgtggatgactggctcagcgccatcaaaatggtccagtacagggacagcttcctcactgctggcttcacctccctccagctggtcacccagatgacatcagaagacctcctgagaataggcatcaccttggcaggccatcagaagaagatcctgaacagcattcattctatgagggtccagataagtcagtcaccaacggcaatggcatgagaactcttgtttcttggggaaggagaggagggaaaaggaccagggtcaagggggaccaaatatataataataaaaatataaaaaggtgatgttcaacagaagtgaagacaaaacaatatgcatcaggagaacaagagtaaacccagctcccactctcagtgggctgcagttgcccaaccacaggaagaaagggaaggaggtagagggaagaaacagaagcagtgttccattttcttcctcaccaatgacattcttttcttttctcctttcgtactcctccctgagagtcccctcccttctcccacactcgtttccctttgctcatgactcctgtagggaagtttcttcaaacaaaacccagctcctgagtctccagatgttgttctgtcagttgccaaaggactttgctgaccactgcatggggatccaaccaattcaattaatgtcttcatattgaagaagagatgtaccttcaattgaaaacctcgtttttcttttgtttgcattttctgcaaaaaggaaaaagaaaccacaaattggggaaaaaaaaagaagaaaaacctgtttccgtgtgcaaaagcacacatatgtatgtctgtgttataaaatgactgtgcttgttcgtaacagatgcaaacaagaaagaagaactgggaagtctttgtccctaggaaatccaaaggggctggaatatggtgttggtttggctttctggttggcccaatcggcctattggctcaatgggaagagagga

SEQ ID NO: 658 - DNA, 5234 bp, Homo sapiens
ccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgttctctcaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgattggttccaagtctttgctattgtgaatagtgccgcaataaacatatgtgtgcatgtgtctttatagcagccagatttataatcctttgggtatatactcagtaatgggattgctgggtcaaatggcatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattctaactggtttgagatggtatctcactgtggttttgatttgcatttctctgatggccagtgatgatgagcattttttcatgtgttttttggctgcataaatggcttcttttgagaagtgtctgttcatatccttcgcccactttttgatggggttgtttgtttttttcttgtaaatttg

SEQ ID NO: 659 - DNA, 1594 bp, Homo sapiens
aacaaaatacagacaaacaaaactacaatggaagaagaaaacgtcctcaactagacatctgccaaaaatatcatccagaatgccctggcaagttcacttccatttagtgaagtgagataatttggcaattcacgcaagagactgagaaccaagcctcaagccctgcctctgattctgcaggtatggaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaagactctccatttcaagtgacaaaactgtactggcttaatgaaaagtgggactttattgcctcagcttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactgacctcttccaaactctaacacttaacctctgctattctgcataaattctgagaaaagccaaattttctgtcggtctaagaagacatagcctacacccaacatggagataattataaaaaataatgaagcagcatgaggggaaggtatttaatgtgtattttaaagttgggagagattctccttcacctaatttaggtgtttgtgaattggcttgactttttgaagttaatttttaagccttgaacatgtccaactttaagaactttaagaataaatattttaacacaagtg

SEQ ID NO: 660 - DNA, 4395 bp, Homo sapiens
ccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacc

SEQ ID NO: 661 - DNA, 5234 bp, Homo sapiens
ccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggaggtttgacattcacctgcctcggctcacctcttcctccaagccccgccccctctgccccacgtgccggccctcctggtgctctatccactgcagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcaatacaccaagggcgagattttatatgcacatttctggatttttttatacggttttcattgacactcttccctcctcccacctgccaccaggcctcaccaaagcccactgccatggggccatctgggccattcagagactggagtgagatttgggtgtggagggggaggcgccaaggtggaggagcttcccactccaggactgttgatgaaagggacagattgaggaggaagtgggctctgaggctgcagggctggaagtccttgcccacttcccactctcctgccccaatctatctagtacttcccaggcaaataggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgattggttccaagtctttgctattgtgaatagtgccgcaataaacatatgtgtgcatgtgtctttatagcagccagatttataatcctttgggtatatactcagtaatgggattgctgggtcaaatggcatttctagttctagatccctgaggaatcgccacaccgacttccacaatggttgaactagtttacagtcccaccaacagtgtaaaagtgttcctatttctccacatcctctccagcacctgttgtttcctgactttttaatgatcgccattctaactggtttgagatggtatctcactgtggttttgatttgcatttctctgatggccagtgatgatgagcattttttcatgtgttttttggctgcataaatggcttcttttgagaagtgtctgttcatatccttcgcccactttttgatggggttgtttgtttttttcttgtaaatttg

SEQ ID NO: 662 - DNA, 4387 bp, Homo sapiens
ccctggccccccgagcccggggcgcgcgctcccgcccgggccgtccgggccccgcggcgccgcggcccgaggccccgggaagcgcagccatggctctgcggaggctgggggccgcgctgctgctgctgccgctgctcgccgccgtggaagaaacgctaatggactccactacagcgactgctgagctgggctggatggtgcatcctccatcagggtgggaagaggtgagtggctacgatgagaacatgaacacgatccgcacgtaccaggtgtgcaacgtgtttgagtcaagccagaacaactggctacggaccaagtttatccggcgccgtggcgcccaccgcatccacgtggagatgaagttttcggtgcgtgactgcagcagcatccccagcgtgcctggctcctgcaaggagaccttcaacctctattactatgaggctgactttgactcggccaccaagaccttccccaactggatggagaatccatgggtgaaggtggataccattgcagccgacgagagcttctcccaggtggacctgggtggccgcgtcatgaaaatcaacaccgaggtgcggagcttcggacctgtgtcccgcagcggcttctacctggccttccaggactatggcggctgcatgtccctcatcgccgtgcgtgtcttctaccgcaagtgcccccgcatcatccagaatggcgccatcttccaggaaaccctgtcgggggctgagagcacatcgctggtggctgcccggggcagctgcatcgccaatgcggaagaggtggatgtacccatcaagctctactgtaacggggacggcgagtggctggtgcccatcgggcgctgcatgtgcaaagcaggcttcgaggccgttgagaatggcaccgtctgccgaggttgtccatctgggactttcaaggccaaccaaggggatgaggcctgtacccactgtcccatcaacagccggaccacttctgaaggggccaccaactgtgtctgccgcaatggctactacagagcagacctggaccccctggacatgccctgcacaaccatcccctccgcgccccaggctgtgatttccagtgtcaatgagacctccctcatgctggagtggacccctccccgcgactccggaggccgagaggacctcgtctacaacatcatctgcaagagctgtggctcgggccggggtgcctgcacccgctgcggggacaatgtacagtacgcaccacgccagctaggcctgaccgagccacgcatttacatcagtgacctgctggcccacacccagtacaccttcgagatccaggctgtgaacggcgttactgaccagagccccttctcgcctcagttcgcctctgtgaacatcaccaccaaccaggcagctccatcggcagtgtccatcatgcatcaggtgagccgcaccgtggacagcattaccctgtcgtggtcccagccggaccagcccaatggcgtgatcctggactatgagctgcagtactatgagaaggagctcagtgagtacaacgccacagccataaaaagccccaccaacacggtcaccgtgcagggcctcaaagccggcgccatctatgtcttccaggtgcgggcacgcaccgtggcaggctacgggcgctacagcggcaagatgtacttccagaccatgacagaagccgagtaccagacaagcatccaggagaagttgccactcatcatcggctcctcggccgctggcctggtcttcctcattgctgtggttgtcatcgccatcgtgtgtaacagaagacgggggtttgagcgtgctgactcggagtacacggacaagctgcaacactacaccagtggccacatgaccccaggcatgaagatctacatcgatcctttcacctacgaggaccccaacgaggcagtgcgggagtttgccaaggaaattgacatctcctgtgtcaaaattgagcaggtgatcggagcaggggagtttggcgaggtctgcagtggccacctgaagctgccaggcaagagagagatctttgtggccatcaagacgctcaagtcgggctacacggagaagcagcgccgggacttcctgagcgaagcctccatcatgggccagttcgaccatcccaacgtcatccacctggagggtgtcgtgaccaagagcacacctgtgatgatcatcaccgagttcatggagaatggctccctggactcctttctccggcaaaacgatgggcagttcacagtcatccagctggtgggcatgcttcggggcatcgcagctggcatgaagtacctggcagacatgaactatgttcaccgtgacctggctgcccgcaacatcctcgtcaacagcaacctggtctgcaaggtgtcggactttgggctctcacgctttctagaggacgatacctcagaccccacctacaccagtgccctgggcggaaagatccccatccgctggacagccccggaagccatccagtaccggaagttcacctcggccagtgatgtgtggagctacggcattgtcatgtgggaggtgatgtcctatggggagcggccctactgggacatgaccaaccaggatgtaatcaatgccattgagcaggactatcggctgccaccgcccatggactgcccgagcgccctgcaccaactcatgctggactgttggcagaaggaccgcaaccaccggcccaagttcggccaaattgtcaacacgctagacaagatgatccgcaatcccaacagcctcaaagccatggcgcccctctcctctggcatcaacctgccgctgctggaccgcacgatccccgactacaccagctttaacacggtggacgagtggctggaggccatcaagatggggcagtacaaggagagcttcgccaatgccggcttcacctcctttgacgtcgtgtctcagatgatgatggaggacattctccgggttggggtcactttggctggccaccagaaaaaaatcctgaacagtatccaggtgatgcgggcgcagatgaaccagattcagtctgtggagggccagccactcgccaggaggccacgggccacgggaagaaccaagcggtgccagccacgagacgtcaccaagaaaacatgcaactcaaacgacggaaaaaaaaagggaatgggaaaaaagaaaacagatcctgggagggggcgggaaatacaaggaatattttttaaagaggattctcataaggaaagcaatgactgttcttgcgggggataaaaaagggcttgggagattcatgcgatgtgtccaatcggagacaaaagcagtttctctccaactccctctgggaaggtgacctggccagagccaagaaacactttcagaaaaacaaatgtgaaggggagagacaggggccgcccttggctcctgtccctgctgctcctctaggcctcactcaacaaccaagcgcctggaggacgggacagatggacagacagccaccctgagaacccctctgggaaaatctattcctgccaccactgggcaaacagaagaatttttctgtctttggagagtattttagaaactccaatgaaagacactgtttctcctgttggctcacagggctgaaaggggcttttgtcctcctgggtcagggagaacgcggggaccccagaaaggtcagccttcctgaggatgggcaacccccaggtctgcagctccaggtacatatcacgcgcacagcctggcagcctggccctcctggtgcccactcccgccagcccctgcctcgaggactgatactgcagtgactgccgtcagctccgactgccgctgagaagggttgatcctgcatctgggtttgtttacagcaattcctggactcgggggtattttggtcacagggtggttttggtttagggggtttgtttgttgggttgttttttgttttttggttttttttaatgacaatgaagtgacactttgacatttcctaccttttgaggacttgatccttctccaggaagaaggtgctttctgcttactgacttaggcccctttgaggctcctgagtgccctcagatggtcaaaacccagttttccctctgggagcctaaaccaggctgcatcggaggccaggacccggatcattcactgtgataccctgccctccagagggtgcgctcagagacacgggcaagcatgcctcttcccttccctggagagaaagtgtgtgatttctctcccacctccttccccccaccagacctttgctgggcctaaaggtcttggccatggggacgccctcagtctagggatctggccacagactccctcctgtgaaccaacacagacacccaagcagagcaatcagttagtgaattgaatggaaataaacgctt

SEQ ID NO: 663 - DNA, 3935 bp, Homo sapiens
cctcgcgcaagcgggtcactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatgcaccttccctgataggtgtggtaaggaaggactgggcatcccaaaatagcattgccctatcatggcaagcacctgctttttccaatggagccattctggactacgagatcaagtactatgagaaagaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagatccttcccggccattggggtggaggcgttttgccccagcttcctgagggcagggtttttaaatagcatccaggccccgcatccagtgccagggggaggatctttgccccccaggattcctgctggcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtaatgccagagtcccctggtgaagttccggaatatcctttgtttgtcacagttggtgactggctagattctataaagatggggcaatacaagaataacttcgtggcagcagggtttacaacatttgacctgatttcaagaatgagcattgatgacattagaagaattggagtcatacttattggacaccagagacgaatagtcagcagcatacagactttacgtttacacatgatgcacatacaggagaagggatttcatgtatgaaagtaccacaagcacctgtgttttgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatgcaacagctttaaaacctatctcagcccatgaatggaaaacaaatccaaatccgatccttgaaaagcaaaggctctaaagaagctcttcagaagagacggtaaagaatgaattcttttacttatcacccaaccacatttcttaaaaatgtgttttggtgtcttttcctaccaaatttctgctctacaaggcagtcagttaaatctctcatttcataattttcactgtgctagttctttcttttctcctcttttaataaattttctaaaactttct

SEQ ID NO: 664 - DNA, 3809 bp, Homo sapiens
cctcgcgcaagcgggtcactgtggtggatgcaattcccctcgcctccagccgcgaggagctccccggcgccgcaggcagcgtcctcctccgaagcagctgcacctgcaactgggcagcctggaccctcgtgccctgttcccgggacctcgcgcagggggcgccccgggacaccccctgcgggccgggtggaggaggaagaggaggaggaggaagaagacgtggacaaggacccccatcctacccagaacacctgcctgcgctgccgccacttctctttaagggagaggaaaagagagcctaggagaaccatggggggctgcgaagtccgggaatttcttttgcaatttggtttcttcttgcctctgctgacagcgtggccaggcgactgcagtcacgtctccaacaaccaagttgtgttgcttgatacaacaactgtactgggagagctaggatggaaaacatatccattaaatgggtgggatgccatcactgaaatggatgaacataataggcccattcacacataccaggtatgtaatgtaatggaaccaaaccaaaacaactggcttcgtacaaactggatctcccgtgatgcagctcagaaaatttatgtggaaatgaaattcacactaagggattgtaacagcatcccatgggtcttggggacttgcaaagaaacatttaatctgttttatatggaatcagatgagtcccacggaattaaattcaagccaaaccagtatacaaagatcgacacaattgctgctgatgagagttttacccagatggatttgggtgatcgcatcctcaaactcaacactgaaattcgtgaggtggggcctatagaaaggaaaggattttatctggcttttcaagacattggggcgtgcattgccctggtttcagtccgtgttttctacaagaaatgccccttcactgttcgtaacttggccatgtttcctgataccattccaagggttgattcctcctctttggttgaagtacggggttcttgtgtgaagagtgctgaagagcgtgacactcctaaactgtattgtggagctgatggagattggctggttcctcttggaaggtgcatctgcagtacaggatatgaagaaattgagggttcttgccatgcttgcagaccaggattctataaagcttttgctgggaacacaaaatgttctaaatgtcctccacacagtttaacatacatggaagcaacttctgtctgtcagtgtgaaaagggttatttccgagctgaaaaagacccaccttctatggcatgtaccaggccaccttcagctcctaggaatgtggtttttaacatcaatgaaacagcccttattttggaatggagcccaccaagtgacacaggagggagaaaagatctcacatacagtgtaatctgtaagaaatgtggcttagacaccagccagtgtgaggactgtggtggaggactccgcttcatcccaagacatacaggcctgatcaacaattccgtgatagtacttgactttgtgtctcacgtgaattacacctttgaaatagaagcaatgaatggagtttctgagttgagtttttctcccaagccattcacagctattacagtgaccacggatcaagatgcaccttccctgataggtgtggtaaggaaggactgggcatcccaaaatagcattgccctatcatggcaagcacctgctttttccaatggagccattctggactacgagatcaagtactatgagaaagaacatgagcagctgacctactcttccacaaggtccaaagcccccagtgtcatcatcacaggtcttaagccagccaccaaatatgtatttcacatccgagtgagaactgcgacaggatacagtggctacagtcagaaatttgaatttgaaacaggagatgaaacttctgacatggcagcagaacaaggacagattctcgtgatagccaccgccgctgttggcggattcactctcctcgtcatcctcactttattcttcttgatcactgggagatgtcagtggtacataaaagccaagatgaagtcagaagagaagagaagaaaccacttacagaatgggcatttgcgcttcccgggaattaaaacttacattgatccagatacatatgaagacccatccctagcagtccatgaatttgcaaaggagattgatccctcaagaattcgtattgagagagtcattggggcaggtgaatttggagaagtctgtagtgggcgtttgaagacaccagggaaaagagagatcccagttgccattaaaactttgaaaggtggccacatggatcggcaaagaagagattttctaagagaagctagtatcatgggccagtttgaccatccaaacatcattcgcctagaaggggttgtcaccaaaagcagaccagtaatgattgtggtggaatatatggagaatggatccctagactcctttttgcggaagcatgatggccacttcacagtcatccagttggtcggaatgctccgaggcattgcatcaggcatgaagtatctttctgatatgggttatgttcatcgagacctagcggctcggaatatactggtcaatagcaacttagtatgcaaagtttctgattttggtctctccagagtgctggaagatgatccagaagctgcttatacaacaactggtggaaaaatccccataaggtggacagccccagaagccatcgcctacagaaaattctcctcagcaagcgatgcatggagctatggcattgtcatgtgggaggtcatgtcctatggagagagaccttattgggaaatgtctaaccaagatgtcattctgtccattgaagaagggtacagacttccagctcccatgggctgtccagcatctctacaccagctgatgctccactgctggcagaaggagagaaatcacagaccaaaatttactgacattgtcagcttccttgacaaactgatccgaaatcccagtgcccttcacaccctggtggaggacatccttgtaatgccagagtcccctggtgaagttccggaatatcctttgtttgtcacagttggtgactggctagattctataaagatggggcaatacaagaataacttcgtggcagcagggtttacaacatttgacctgatttcaagaatgagcattgatgacattagaagaattggagtcatacttattggacaccagagacgaatagtcagcagcatacagactttacgtttacacatgatgcacatacaggagaagggatttcatgtatgaaagtaccacaagcacctgtgttttgtgcctcagcatttctaaaatgaacgatatcctctctactactctctcttctgattctccaaacatcacttcacaaactgcagtcttctgttcagactataggcacacaccttatgtttatgcttccaaccaggattttaaaatcatgctacataaatccgttctgaataacctgcaactaaaaccctggcccactgcagattattgctacgcaatgcaacagctttaaaacctatctcagcccatgaatggaaaacaaatccaaatccgatccttgaaaagcaaaggctctaaagaagctcttcagaagagacggtaaagaatgaattcttttacttatcacccaaccacatttcttaaaaatgtgttttggtgtcttttcctaccaaatttctgctctacaaggcagtcagttaaatctctcatttcataattttcactgtgctagttctttcttttctcctcttttaataaattttctaaaactttct

SEQ ID NO: 665 - DNA, 6936 bp, Homo sapiens
actgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaagggttccatgagccagatccgaattgaggctggagtgagtgcctgtgagccaggggtggccattctgccctaagttccatgcggacagccaggctgtgaagctgaatctagctgagattagactacacagacctctgagaccaatttcaactctgagacttgatgattcttccaaacagtcctccaaacagaacagatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaagtgcttaagcagtatgtcaacagcactcagcaaaatggcttctccagcgacagtgcatctgacagaaaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacattatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 666 - DNA, 6818 bp, Homo sapiens
atcctcccttcactgggagagaacttctctcccagggcggtgcgacccggagctccagcgcccgagtctccacttcgtttgctgaaacttgctttctaccagctaagaaccatgctgcgagtgattgtggaatctgccagcaatatccctaaaacgaaatttggcaagccggatcctattgtttctgtcatttttaaggatgagaaaaagaaaacaaagaaagttgataatgaattgaaccctgtctggaatgagattttggagtttgacttgaggggtataccactggacttttcatcttcccttgggattattgtgaaagattttgagacaattggacaaaataaattaattggcacggcgactgtagccctgaaggacctgactggtgaccagagcagatccctgccgtacaagctgatctccctgctaaatgaaaaagggcaagatactggggccaccattgacttggtgatcggctatgatccgccttctgctccacatccaaatgacctgagcgggcccagcgtgccaggcatgggaggagatggggaagaagatgaaggtgatgaagacaggttggacaatgcagtcaggggccctgggcccaaggggccagttgggacggtgtcggaagctcagcttgctcggaggctcaccaaagtaaagaacagccggcggatgctgtcaaataagccacaggacttccagatccgcgtccgagtgattgagggccgacagttaagtggtaacaacataaggcctgtggtcaaagttcacgtctgtggccagacacaccgaacaagaatcaagagaggaaacaaccctttttttgatgagttgtttttctacaatgtcaacatgaccccttctgaattgatggatgagatcatcagcatccgggtttataattctcactctctgcgggcagattgtctgatgggggaatttaagattgatgttggatttgtttatgatgaacctggccatgctgtcatgagaaagtggcttcttctcaatgacccggaagataccagttcaggttctaaaggttatatgaaagtcagcatgtttgtcctgggaaccggagatgagcctcctcctgagagacgagatcgtgataatgacagtgatgatgtggagagtaatttgttactccctgctggcattgccctccggtgggtgaccttcttgctgaaaatctaccgagctgaggacatcccccagatggatgatgccttctcacagacagtaaaggaaatatttggaggcaatgcagataagaaaaatctcgtggatccttttgtagaagtttcctttgctggaaaaaaggtttgtacaaacataattgagaaaaatgcaaacccagagtggaatcaggtcgtcaatcttcagatcaagtttccttcagtgtgtgaaaaaataaaactaacaatatatgactgggaccgtcttactaaaaatgatgtagttggaacaacatatctacacctctctaaaattgctgcctctggtggggaagtggaagatttctcatcttcgggaactggggctgcatcatatacagtaaacacaggagaaacagaggtaggctttgttccaacgtttggaccttgttacctgaatctttatggaagccccagagagtacacgggattcccagacccctatgatgagctgaatactggaaagggggaaggagttgcctacagaggcaggatcttggttgaattagccacttttcttgagaagacaccaccagataaaaagcttgagcccatttcaaatgatgacctgctggttgttgagaaataccagcgaaggcggaagtacagcctgtctgccgtgtttcattcagccaccatgttgcaagatgttggtgaggccattcagtttgaagtcagcattgggaactatggcaacaagtttgacaccacctgtaagcctttggcatcaacaactcagtacagccgtgctgtatttgatggcaactactattattacttgccttgggcccacaccaagccagttgttaccctgacttcatactgggaggatattagtcatcgcctggatgcggtgaacactctcctagctatggcagaacggctgcaaacaaatatagaagctctaaaatcagggatacaaggtaaaattcctgcaaaccagctggctgaattgtggctgaagctgatagatgaagttatagaagacacgagatacacgttgcctctcacagaaggaaaagccaacgtcacagttctcgatactcagatccgaaagctgcggtccaggtctctctcccaaatacatgaggcggctgtgaggatgaggtcggaagccacagatgtgaagtccacactggcagaaattgaggactggcttgataaattaatgcagctgactgaagagccacagaacagcatgcctgacatcatcatctggatgatccggggagagaagagactggcctatgcacgaattcccgcacatcaggtcttgtactccaccagtggtgagaatgcatctggaaaatactgtgggaaaacccaaaccatctttctgaagtatccacaggagaaaaacaacgggccaaaggtgcctgtggagttgcgagtgaacatctggctaggcttaagtgctgtggagaagaagtttaacagcttcgcagaaggaactttcaccgtctttgctgaaatgtatgaaaatcaagctctcatgtttggaaaatggggtacttctggattagtaggacgtcataagttttctgatgtcacaggaaaaataaaactcaagagggaattttttctgcctccaaaaggctgggaatgggaaggagagtggatagttgatcctgaaagaagcttgctgactgaggcagatgcaggtcacacggagttcactgatgaagtctatcagaacgagagccgctaccccgggggcgactggaagccggccgaggacacctacacggatgcgaacggcgataaagcagcatcacccagcgagttgacttgtcctccaggttgggaatgggaagatgatgcatggtcttatgacataaatcgagcggtggatgagaaaggctgggaatatggaatcaccattcctcctgatcataagcccaaatcctgggttgcagcagagaaaatgtaccacactcatagacggcgaaggctggtccgaaaacgcaagaaagatttaacacagactgcttcaagcaccgcaagggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttggggcagacactaccgaagatggggatgagaagagcctggagaaacagaagcacagtgccaccactgtgttcggagcaaacacccccattgtttcctgcaattttgacagagtctacatctaccatctgcgctgctatgtctatcaagccagaaacctcttggctttagataaggatagcttttcagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtgggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggatggctccaaccttcccattcttccccctcaaagggcgccaaatctatacatggtcccccaggggatcaggcctgtggtccagctcactgccattgagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtgttcttgcccaaggaggaattgtacatgcccccactggtgatcaaggtcatcgaccacaggcagtttgggcggaagcctgtcgtcggccagtgcaccatcgagcgcctggaccgctttcgctgtgacccttatgcagggaaagaggacatcgtcccacagctcaaagcctcccttctgtctgccccaccatgccgggacatcgttatcgaaatggaagacaccaaaccattactggcttctaaggaggaagaaatcgtggactggtggagtaaattttatgcttcctcaggggaacatgaaaaatgcggacagtatattcagaaaggctattccaagctcaagatatataattgtgaactagaaaatgtagcagaatttgagggcctgacagacttctcagatacgttcaagttgtaccgaggcaagtcggatgaaaatgaagatccttctgtggttggagagtttaagggctcctttcggatctaccctctgccggatgaccccagcgtgccagcccctcccagacagtttcgggaattacctgacagcgtcccacaggaatgcacggttaggatttacattgttcgaggcttagagctccagccccaggacaacaatggcctgtgtgacccttacataaaaataacactgggcaaaaaagtcattgaagaccgagatcactacattcccaacactctcaacccagtctttggcaggatgtacgaactgagctgctacttacctcaagaaaaagacctgaaaatttctgtctatgattatgacacctttacccgggatgaaaaagtaggagaaacaattattgatctggaaaaccgattcctttcccgctttgggtcccactgcggcataccagaggagtactgtgtttctggagtcaatacctggcgagatcaactgagaccaacacagctgcttcaaaatgtcgccagattcaaaggcttcccacaacccatcctttccgaagatgggagtagaatcagatatggaggacgagactacagcttggatgaatttgaagccaacaaaatcctgcaccagcacctcggggcccctgaagagcggcttgctcttcacatcctcaggactcaggggctggtccctgagcacgtggaaacaaggactttgcacagcaccttccagcccaacatttcccagggaaaacttcagatgtgggtggatgttttccccaagagtttggggccaccaggccctcctttcaacatcacaccccggaaagccaagaaatactacctgcgtgtgatcatctggaacaccaaggacgttatcttggacgagaaaagcatcacaggagaggaaatgagtgacatctacgtcaaaggctggattcctggcaatgaagaaaacaaacagaaaacagatgtccattacagatctttggatggtgaagggaattttaactggcgatttgttttcccgtttgactaccttccagccgaacaactctgtatcgttgcgaaaaaagagcatttctggagtattgaccaaacggaatttcgaatcccacccaggctgatcattcagatatgggacaatgacaagttttctctggatgactacttgggtttcctagaacttgacttgcgtcacacgatcattcctgcaaaatcaccagagaaatgcaggttggacatgattccggacctcaaagccatgaacccccttaaagccaagacagcctccctctttgagcagaagtccatgaaaggatggtggccatgctacgcagagaaagatggcgcccgcgtaatggctgggaaagtggagatgacattggaaatcctcaacgagaaggaggccgacgagaggccagccgggaaggggcgggacgaacccaacatgaaccccaagctggacttaccaaatcgaccagaaacctccttcctctggttcaccaacccatgcaagaccatgaagttcatcgtgtggcgccgctttaagtgggtcatcatcggcttgctgttcctgcttatcctgctgctcttcgtggccgtgctcctctactctttgccgaactatttgtcaatgaagattgtaaagccaaatgtgtaacaaaggcaaaggcttcatttcaagagtcatccagcaatgagagaatcctgcctctgtagaccaacatccagtgtgattttgtgtctgagaccacaccccagtagcaggttacgccatgtcaccgagccccattgattcccagagggtcttagtcctggaaagtcaggccaacaagcaacgtttgcatcatgttatctcttaagtattaaaagttttattttctaaagtttaaatcatgtttttcaaaatatttttcaaggtggctggttccatttaaaaatcatctttttatatgtgtcttcggttctagacttcagcttttggaaattgctaaatagaattcaaaaatctctgcatcctgaggtgatatacttcatatttgtaatcaactgaaagagctgtgcattataaaatcagttagaatagttagaacaattcttatttatgcccacaaccattgctatattttgtatggatgtcataaaagtctatttaacctctgtaatgaaactaaataaaaatgtttcaccttt

SEQ ID NO: 667 - DNA, 3858 bp, Homo sapiens
gagaagaaagccagtgcgtctctgggcgcaggggccagtggggctcggaggcacaggcaccccgcgacactccaggttccccgacccacgtccctggcagccccgattatttacagcctcagcagagcacggggcgggggcagaggggcccgcccgggagggctgctacttcttaaaacctctgcgggctgcttagtcacagccccccttgcttgggtgtgtccttcgctcgctccctccctccgtcttaggtcactgttttcaacctcgaataaaaactgcagccaacttccgaggcagcctcattgcccagcggaccccagcctctgccaggttcggtccgccatcctcgtcccgtcctccgccggcccctgccccgcgcccagggatcctccagctcctttcgcccgcgccctccgttcgctccggacaccatggacaagttttggtggcacgcagcctggggactctgcctcgtgccgctgagcctggcgcagatcgatttgaatataacctgccgctttgcaggtgtattccacgtggagaaaaatggtcgctacagcatctctcggacggaggccgctgacctctgcaaggctttcaatagcaccttgcccacaatggcccagatggagaaagctctgagcatcggatttgagacctgcagtttgcattgcagtcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcagaatgtggacatgaagattggggtgtaacacctacaccattatcttggaaagaaacaaccgttggaaacataaccattacagggagctgggacacttaacagatgcaatgtgctactgattgtttcattgcgaatcttttttagcataaaattttctactctttttgttttttgtgttttgttctttaaagtcaggtccaatttgtaaaaacagcattgctttctgaaattagggcccaattaataatcagcaagaatttgatcgttccagttcccacttggaggcctttcatccctcgggtgtgctatggatggcttctaagacatttcccagggttaatagggcctggtccctgggaggaaatttgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataattttttaaagttactttgtcagaggcacaaaagggtttaaactgattcataataaatatctgtacttcttcgatcttcaccttttgtgctgtgattcttcagtttctaaaccagcactgtctgggtccctacaatgtatcaggaagagctgagaatggtaaggagactcttctaagtcttcatctcagagaccctgagttcccactcagacccactcagccaaatctcatggaagaccaaggagggcagcactgtttttgttttttgttttttacactgtccaaaggttttccatcctgtcctggaatcagagttggaagctgaggagcttcagcctcttttatggtttaatggccacctgttctctcctgtgaaaggctttgcaaagtcacattaagtttgcatgacctgttatccctggggccctatttcatagaggctggccctattagtgatttccaaaaacaatatggaagtgccttttgatgtcttacaataagagaagaagccaatggaaatgaaagagattggcaaaggggaaggatgatgccatgtagatcctgtttgacatttttatggctgtatttgtaaacttaaacacaccagtgtctgttcttgatgcagttgctatttaggatgagttaagtgcctggggagtccctcaaaaggttaaagggattcccatcattggaatcttatcaccagataggcaagtttatgaccaaacaagagagtactggctttatcctctaacctcatattttctcccacttggcaagtcctttgtggcatttattcatcagtcagggtgtccgattggtcctagaacttccaaaggctgcttgtcatagaagccattgcatctataaagcaacggctcctgttaaatggtatctcctttctgaggctcctactaaaagtcatttgttacctaaacttatgtgcttaacaggcaatgcttctcagaccacaaagcagaaagaagaagaaaagctcctgactaaatcagggctgggcttagacagagttgatctgtagaatatctttaaaggagagatgtcaactttctgcactattcccagcctctgctcctccctgtctaccctctcccctccctctctccctccacttcaccccacaatctttggtctggatttctttttattttcttttcaacttgaaagaaactggacattaggccactatgtgttgttactgccactagtgttcaagtgcctcttgttttcccagagatttcctgggtctgccagaggcccagacaggctcactcaagctctttaactgaaaagcaacaagccactccaggacaaggttcaaaatggttacaacagcctctacctgtcgccccagggagaaaggggtagtgatacaagtctcatagccagagatggttttccactccttctagatattcccaaaaagaggctgagacaggaggttattttcaattttattttggaattaaatacttttttccctttattactgttgtagtccctcacttggatatacctctgttttcacgatagaaataagggaggtctagagcttctattccttggccattgtcaacggagagctggccaagtcttcacaaacccttgcaacattgcctgaagtttatggaataagatgtattctcactcccttgatctcaagggcgtaactctggaagcacagcttgactacacgtcatttttaccaatgattttcaggtgacctgggctaagtcatttaaactgggtctttataaaagtaaaaggccaacatttaattattttgcaaagcaacctaagagctaaagatgtaatttttcttgcaattgtaaatcttttgtgtctcctgaagacttcccttaaaattagctctgagtgaaaaatcaaaagagacaaaagacatcttcgaatccatatttcaagcctggtagaattggcttttctagcagaacctttccaaaagttttatattgagattcataacaacaccaagaattgattttgtagccaacattcattcaatactgttatatcagaggagtaggagagaggaaacatttgacttatctggaaaagcaaaatgtacttaagaataagaataacatggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaagcacttattggaaaatattaaaaggctaacattaaaagactaaaggaaacagactcagaa

SEQ ID NO: 668 - DNA, 3384 bp, Homo sapiens
ggcgccgtacgtgcgcgcgcgcggcggcccagaaagcggcgctgggaccctgaggcggccgtggttaggcggctccccggcggctcctccgcggcggtgacggcgaccgcactccccgcttcccgctccccgcgctcctccgcccgggtccgccagccgaggccgctcccgagcgtcggaagatgccggccgtgtccaagggggacgggatgcggggcctggcggtcttcatgctcggatatccgcaactgtaaaagtaaagaagcagaaataaaaaggataaacaaggaactggcaaatatcagatcaaaatttaaaggtgacaaggctcttgatggctatagtaaaaaaaagtacgtctgcaagttgctcttcatctttctccttggtcatgacattgactttggacacatggaggctgtgaacctgctgagttcaaacagatacacggaaaagcagatcggctaccttttcatctctgtgttggtgaactcaaacagtgagctgatccgcctgatcaacaacgccatcaagaatgacctggccagccgcaaccccaccttcatgggcctggccctgcactgcatcgccagcgtgggcagccgggagatggccgaggccttcgccggggagatccctaaggtcctcgtagccggagacactatggacagcgtgaagcagagcgcggccctgtgcttgctgcgcctgtacaggacgtcccccgatcttgtccccatgggcgactggacatcccgagtggtgcacctgctcaatgaccagcacttgggtgtggtaactgcagccacaagtctgatcaccactttagcacagaagaacccagaagagtttaaaacctccgtgtctctggctgtctctaggctaagcagaatcgtgacgtctgcatccacagatctccaggattacacttactattttgtcccggctccctggctgtctgtcaaactgctgagactgctgcagtgctacccacccccagaagaccctgcagtgcgaggccgcctgactgagtgcctggagaccatcctgaacaaagcccaagaaccgcccaagtcgaagaaggtccagcactccaacgcgaagaatgccgtgctcttcgaggccatcagcttaatcattcaccatgacagtgagccgaacctgctcgtccgtgcctgcaaccagttgggccagtttctgcagcaccgcgagaccaacctgcgctacctggccctggagagcatgtgcacgctggccagctctgagttctcccatgaggctgtcaagacgcacatcgagacggtcatcaacgccctgaaggcgaactgagcgggacgtgagcgtgcggcagcgggccgtggacctcctctacgccatgtgcgaccgcagcaacgccccacagatcgtggccgagatgctgagctatctggagacagctgactactccatccgagaagagattgtgctgaaggtcgccatcctggctgagaagtacgcggtggactacacctggtatgtggataccatcttgaacttgatccgaattgctggtgattacgtgagtgaagaggtgtggtaccgagtcattcagatcgtcatcaaccgggacgacgtgcagggctacgcggccaagactgtgttcgaggctcttcaggctcccgcgtgccacgagaacctggtcaaagtgggcggctacatcctgggggagtttggaaacttgatagctggagacccgagatccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtgtctacgccttctccgtcggcagacctgctgggtctcggggctgccccccctgcccccgcgggccccccaccctcctccggcggcagcgggctgctcgtggacgtgttctcagactcggcctctgtggtcgcgcctctcgctcctggctccgaagacaactttgccaggtttgtttgtaaaaacaatggtgtgttgtttgaaaaccagctgcttcaaattggacttaagtctgaatttcggcagaatttaggtcggatgtttatcttttatggtaataagacctccacgcagttcctaaactttaccccaacactaatctgttcagacgaccttcagcctaatatcctggattccttaacgcacgcacacctgaacctgcagaccaagcccgtggacccgaccgtggaggggggcgcgcaggtgcagcaggtggtcaacatagagtgcgtgtccgacttcacggaggcgccagtcctcaacattcagttcaggtatgggggcaccttccagaacgtgtctgtgcagctgcccatcactctcaacaaattcttccagccgacagaaatggcttctcaggatttctttcaacgttggaagcagttgagcaatccacagcaggaagtgcagaacatcttcaaagcaaagcacccaatggacacagaagtcaccaaagccaagatcattggatttggttctgcacttcttgaagaagttgatcctaatcctgcgaatttcgtgggagctggaatcatccacacgaaaaccacccagattggatgcctgctgcgcttggagccgaacctgcaagcccagatgtaccggctcacgctgcgcacaagtaaggaagccgtttctcagagattatgtgaattgctctcagcgcagttttagtcctgaggatggaagaccaggctcgtgtgtcttgtgttgtcttcgtctgtgccgtttgtcttcgtggccatccttgtggctcaggaggaaaagctcagcctggactgtggcagccacggcagaaggtggatcttgggatcaatttttataaaaatcgagacagttctgtggttaaatctacaaattaaagggaaattagaagttggcgtgaacgtggcgtttgtgggagtgtcactgagatggcccgtgctgccgctgctccccgaggcaccgcttccctgtgcggcgctgcagaggggccctcagtgtggcactcctcgtcaaagaaaaataaaggctagaactgc

SEQ ID NO: 669 - DNA, 3169 bp, Homo sapiens
gccgagcttggttctggtcccagccggatgtggggggctcggggtccccggttcgctttggggacggttgctgcggtctgttttgggttgttctgaagtccctggactcagcttggcttggagacccagggcagccgggctgggtcgggctcgcgggtggcggcgatttcgaggtgcctggatgcagctggacctgagcgtcccgggacactgagcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtgg

SEQ ID NO: 670 - DNA, 3083 bp, Homo sapiens
gagcgcgccgcctgggccaggcagccgagccgtccgagcagctgggctgggagcagggaacccggagctgggaatcgggagccgggcgcggggagctgcgcgaagccggggcggagcacgcgagctatgcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgaagcccctgccactgccactacccgctccagagctttaaggaaaatgaagtgagacccctccccttaggcctggggagccatagggctggcttctctgtgggtgcgtggacgtggggttgggagctgggaatctattttttgtattatgttttgagctactgtagttttggcgtgg

SEQ ID NO: 671 - DNA, 4140 bp, Homo sapiens
catgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctcc

SEQ ID NO: 672 - DNA, 4269 bp, Homo sapiens
gagcgcgccgcctgggccaggcagccgagccgtccgagcagctgggctgggagcagggaacccggagctgggaatcgggagccgggcgcggggagctgcgcgaagccggggcggagcacgcgagctatgcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctcc

SEQ ID NO: 673 - DNA, 4389 bp, Homo sapiens
gagcgcgccgcctgggccaggcagccgagccgtccgagcagctgggctgggagcagggaacccggagctgggaatcgggagccgggcgcggggagctgcgcgaagccggggcggagcacgcgagctatgcatgcggggcgtgtggccgcccccggtgtccgccctgctgtcggcgctggggatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtag

SEQ ID NO: 674 - DNA, 4145 bp, Homo sapiens
tcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctcc

SEQ ID NO: 675 - DNA, 4265 bp, Homo sapiens
tcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtag

SEQ ID NO: 676 - DNA, 4162 bp, Homo sapiens
cctggattagggctgaatctgtgggaaccagaccacccctgagacaggaggcagccctgatgcctctccagggcctgggcctgcagcggaaccccttcctccaagggaagcggggcccggggctcacgtcttccccgcccctcctgcctccttccctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagaaaacaggctgggcccggtggctcactcctgtaatcccagcactttgggaggttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctcc

SEQ ID NO: 677 - DNA, 4282 bp, Homo sapiens
cctggattagggctgaatctgtgggaaccagaccacccctgagacaggaggcagccctgatgcctctccagggcctgggcctgcagcggaaccccttcctccaagggaagcggggcccggggctcacgtcttccccgcccctcctgcctccttccctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtag

SEQ ID NO: 678 - DNA, 4337 bp, Homo sapiens
gagcgcgccgcctgggccaggcagccgagccgtccgagcagctgggctgggagcagggaacccggagctgggaatcgggagccgggcgcggggagctgcgcgaagccggggcggagcacgcgagctatgatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggcttaccagaactgggtgaagaagaacggggctgagcactcgctccccaccctgggcctcaccaataaccagctcttcttcctgggctttgcacaggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtag

SEQ ID NO: 679 - DNA, 4169 bp, Homo sapiens
tcgggcgcgagagccatggaggcgctgagggagtccgtgctgcatttggccttgcagatgtcgacgtacaagcgggccacgctggacgaggaggacctggtggactcgctctccgagggcgacgcataccccaacggcctgcaggtgaacttccacagcccccggagtggccagaggtgctgggctgcacggacccaggtggagaagcggctggtggtgttggtggtacttctggcggcaggactggtggcctgcttggcagcactgggcatccagtaccagacaagatccccctctgtgtgcctgagcgaagcttgtgtctcagtgaccagctccatcttgagctccatggaccccacagtggacccctgccatgacttcttcagctacgcctgtgggggctggatcaaggccaacccagtccctgatggccactcacgctgggggaccttcagcaacctctgggaacacaaccaagcaatcatcaagcacctcctcgaaaactccacggccagcgtgagcgaggcagagagaaaggcgcaagtatactaccgtgcgtgcatgaacgagaccaggatcgaggagctcagggccaaacctctaatggagttgattgagaggctcgggggctggaacatcacaggtccctgggccaaggacaacttccaggacaccctgcaggtggtcaccgcccactaccgcacctcacccttcttctctgtctatgtcagtgccgattccaagaactccaacagcaacgtgatccaggtggaccagtctggcctgggcttgccctcgagagactattacctgaacaaaactgaaaacgagaaggtgctgaccggatatctgaactacatggtccagctggggaagctgctgggcggcggggacgaggaggccatccggccccagatgcagcagatcttggactttgagacggcactggccaacatcaccatcccacaggagaagcgccgtgatgaggagctcatctaccacaaagtgacggcagccgagctgcagaccttggcacccgccatcaactggttgccttttctcaacaccatcttctaccccgtggagatcaatgaatccgagcctattgtggtctatgacaaggaataccttgagcagatctccactctcatcaacaccaccgacagatgcctgctcaacaactacatgatctggaacctggtgcggaaaacaagctccttccttgaccagcgctttcaggacgccgatgagaagttcatggaagtcatgtacgggaccaagaagacctgtcttcctcgctggaagttttgcgtgagtgacacagaaaacaacctgggctttgcgttgggccccatgtttgtcaaagcaaccttcgccgaggacagcaagagcatagccaccgagatcatcctggagattaagaaggcatttgaggaaagcctgagcaccctgaagtggatggatgaggaaacccgaaaatcagccaaggaaaaggccgatgccatctacaacatgataggataccccaacttcatcatggatcccaaggagctggacaaagtgtttaatgactacactgcagttccagacctctactttgaaaatgccatgcggtttttcaacttctcatggagggtcactgccgatcagctcaggaaagcccccaacagagatcagtggagcatgaccccgcccatggtgaacgcctactactcgcccaccaagaatgagattgtgtttccggccgggatcctgcaggcaccattctacacacgctcctcacccaaggccttaaactttggtggcataggtgtcgtcgtgggccatgagctgactcatgcttttgatgatcaaggacgggagtatgacaaggacgggaacctccggccatggtggaagaactcatccgtggaggccttcaagcgtcagaccgagtgcatggtagagcagtacagcaactacagcgtgaacggggagccggtgaacgggcggcacaccctgggggagaacatcgccgacaacgggggtctcaaggcggcctatcgggtctggtgctccgtccgcacacctgagagctcccacgaaggcctcatcaccgatccccacagcccctctcgcttccgggtcatcggctccctctccaattccaaggagttctcagaacacttccgctgcccacctggctcacccatgaacccgcctcacaagtgcgaagtctggtaaggacgaagcggagagagccaagacggaggaggggaaggggctgaggacgagacccccatccagcctccagggcattgctcagcccgcttggccacccggggccctgcttcctcacactggcgggttttcagccggaaccgagcccatggtgttggctctcaacgtgacccgcagtctgatcccctgtgaagagccggacatcccaggcacacgtgtgcgccaccttcagcaggcattcgggtgctgggctggtggctcatcaggcctgggccccacactgacaagcgccagatacgccacaaataccactgtgtcaaatgctttcaagatatatttttggggaaactattttttaaacactgtggaatacactggaaatcttcagggaaaaacacatttaaacacttttttttttaaggaaagaattggtatatttattatgttctgtttttctaaataacctgtggacaagggaagccccactgatttactccctctcttccccactccctgtgaggctgggctgaggcacggatccctgggccacagagcaagtctccaaatcagacagctgcctcagcccctgggatgtgtgatttcagctcctgtcacctcatgcaagggcgtggagaccagtagaggtgtggaggccaggcagagagaggagcctgctctgcggggggcccagctcatgggcactgccccttcagctagcctgcctccgtcccctgagtccaacagtgggagccctagctgggaagttctgatccccaaagccacagcaggggactgatggctatagcagaatgaggtcgggtcaggaccctcaaacaccatctgggaacaccaagcaccctgaatcgagactgcaggagccctgcggggtgagactgtgtcagagatacactgctggccacaagtgtcccctctcagtcccaccttttcgggctgtcccatgtctatctcaggggcccgttacctctctgcagcagtcccccatcccagccacaccagggtctgtccggccaaccctcttccccagggaaaggagaaaagagttgaggtgggcggatcacctgaggtcaggagtttgagaccagcctggccaacgtggtgaaaccccatctctactaaaaaaaattacaaaaattagccgggagtggtggtgggcacctgtaatcccagttactcgggaggctgaggcaagagaatctcttgagctcaggaggcagaggttgcagtgagctgagattgcgccactgcactccagcctgggtgacagagggagactccgtcccaaaaaaaagaaaagagaaacagctgtcacctcccgcaggacccaaatcctctctctgagcaccgtcatccaccacatggctgggcctggctcccaggaccagtccagtcctctagtgccttatctgaggctgcagccgccagtctccaccccaaggagacagcccctgctcctagatgcccttggcctccgcagtgcagcccccaggtgtcctgactgaagcacaggccatagccccatttccccggtgcctgcagggctaacctccacgggagcccaggagctctggccggcaggtccatggcacagggcatcggaagactgcaaaactgctggacttaccctgggctgcagtccattgtcggcccctgggttgaatcaagatagtacttgcagctagatggatgcttttagccaggggacattgtgaggggaagattcctccacccagtctggcctgtggtgtctgtctcctccctggaatcctcctgcccgagaggaagcagacggcacagggacacccctgccaccttgggatctgcctccaagctggtgcagggtatcgagagtggattccagatggaggtcctggtcccagcacgcagcagtcctggtagctctgcagaggagacaggaacccgagaagtag

SEQ ID NO: 680 - DNA, 1014 bp, Homo sapiens
cccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtcatggggcaacacggttagcggggagagcacggggtagccggagaagggcctctggagcaggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacctg

SEQ ID NO: 681 - DNA, 950 bp, Homo sapiens
cccgtagaagattccagcaccctcccctaactccaggccagactcctttcagctaaaggggagatctggatggcatctacttcgtatgactattgcagagtgcccatggaagacggggataagcgctgtaagcttctgctggggataggaattctggtgctcctgatcatcgtgattctgggggtgcccttgattatcttcaccatcaaggccaacagcgaggcctgccgggacggccttcgggcagtgatggagtgtcgcaatgtcacccatctcctgcaacaagagctgaccgaggcccagaagggctttcaggatgtggaggcccaggccgccacctgcaaccacactgtgatggccctaatggcttccctggatgcagagaaggcccaaggacaaaagaaagtggaggagcttgagggagagatcactacattaaaccataagcttcaggacgcgtctgcagaggtggagcgactgagaagagaaaaccaggtcttaagcgtgagaatcgcggacaagaagtactaccccagctcccaggactccagctccgctgcggcgccccagctgctgattgtgctgctgggcctcagcgctctgctgcagtgagatcccaggaagctggcacatcttggaaggtccgtcctgctcggcttttcgcttgaacattcccttgatctcatcagttctgagcgggtctggaggggccatggggcagtcctgggtgtggggacacagtcgggttgacccagggctgtctccctccagagcctccctccggacaatgagtcccccctcttgtctcccaccctgagattgggcatggggtgcggtgtggggggcatgtgctgcctgttgttatgggttttttttgcggggggggttgcttttttctggggtctttgagctccaaaaaataaacacttcctttgagggagagcacacct

SEQ ID NO: 682 - DNA, 973 bp, Homo sapiens
atagctgaagaacaactgcaagttgaattgttcgtgaaggctggcagtgatggggccaagattgggaactgccccttctagagactgttcatggtgctgtggctcaagggagtcaccttcaatgtcaccatcattgacaccaagaggcagaccaagatagtgcaaaagctgtgcccaggagggcagctcccattcctgctgtatggcatggaagaacacaaggacaccaacaagattgaggaatttctgtaggcagtgctgtgccctcctaggtaccccaagctggcagctctgaaccctgaatccaacacagctgagcaggacatatttgccaaattttctgcttacatcaagaattcaaacccagtagtcaatgacaatctggagaagggactcctgaaagccctgaaggttttagacaatcacttgatatcctgccactcagaagaagtggatgaaaccagtgctgaagatgaaggcatctctcagaggaagtttctggatggcaatgagctcaccctggctgactgcaacctgttgctaacgctccacatagtacaagtggtgtgtaagaaaaaaaaaaaataccagggattcaccatccctgaggccttccagggcgtgcagcagtacttgagcaatgcctatgctcaggaagaatctgcctccacctgtccagatgatgagatcaagctcacctatgagcaaggatccaaggccctccaataagcccctcttgggactccttcagccccctccattttctccacaaaggccctggtggtttccacattgctacccaaaggacacactccagaatggccagtgggcagggaatcctggagcacttgtcccgggatggtgtggtggaagaggggataagggaaagaaatagggagcctggatgagatttttactgtggggtgggatgggtaggacaacatatttcagtagtaaaatacagaataaaatt

SEQ ID NO: 683 - DNA, 1251 bp, Homo sapiens
gttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggctggcagtgatggggccaagattgggaactgcccattctcccagagactgttcatggtactgtggctcaagggagtcaccttcaatgttaccaccgttgacaccaaaaggcggaccgagacagtgcagaagctgtgcccaggggggcagctcccattcctgctgtatggcactgaagtgcacacagacaccaacaagattgaggaatttctggaggcagtgctgtgccctcccaggtaccccaagctggcagctctgaaccctgagtccaacacagctgggctggacatatttgccaaattttctgcctacatcaagaattcaaacccagcactcaatgacaatctggagaagggactcctgaaagccctgaaggttttagacaattacttaacatcccccctcccagaagaagtggatgaaaccagtgctgaagatgaaggtgtctctcagaggaagtttttggatggcaacgagctcaccctggctgactgcaacctgttgccaaagttacacatagtacaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaa

SEQ ID NO: 684 - DNA, 2718 bp, Homo sapiens
ccccagcgcgggagaaacgttctcactcgctctctgctcgctgcgggcgctccccgccctctgctgccagaaccttggggatgtgcctagacccggcgcagcacacgtccgggccaaccgcgagcagaacaaacctttggcgggcggccaggaggctccctcccagccaccgcccccctccagcgcctttttttccccccatacaatacaagatcttccttcctcagttcccttaaagcacagcccagggaaacctcctcacagttttcatccagccacgggccagcatgtctgggggcaaatacgtagactcggagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaaca

SEQ ID NO: 685 - DNA, 3178 bp, Homo sapiens
cctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctcgggagcccctgagctaggaggacacggaaaaggggattggggtcctgagattgggtctgttgggcccaggacgcgttttctggatgggtctaggatgctcccctgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgttaagggaagaattccagggtatggccatggagtgtacaagtatgtgggcagattttcagcaaactcttttcccactgtttaaggagttagtggattactgccattcacttcataatccagtaggatccagtgatccttacaagttagaaaacataatcttctgccttctcatgatccaactaatgccttactcttcttgaaattttaacctatgatattttctgtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatatttttatctttatatgaagaaaatcacttaggaaatggctttgtgattcaatctgtaaactgtgtattccaagacatgtctgttctacatagatgcttagtccctcatgcaaatcaattactggtccaaaagattgctgaaattttatatgcttactgatatattttacaattttttatcatgcatgtcctgtaaaggttacaagcctgcacaataaaaatgtttaacggttaaaca

SEQ ID NO: 686 - DNA, 2785 bp, Homo sapiens
cctcctcacagttttcatccagccacgggccagcatgtctgggggcaaatacgtagactcggaggtaggcatccgtgggggggcgccggctcgggcgtgcggggagtgtccgcttctgctatctgcctctccaaatatcccgactgctgccctggccccagccctctctccacttcggagcactcctctggcgttggcaccgctgaggaatgggcctgggcggggaggtgaagagaagccaggaatgttttatgttttcctaatggagagggggcctcgggagcccctgagctaggaggacacggaaaaggggattggggtcctgagattgggtctgttgggcccaggacgcgttttctggatgggtctaggatgctcccctgtcgcgggacccccgcggtccggccctgcctgctgggggttcgaagaggtggagtgcagggtggaggtgttatttacccgagtcctggggacagtccccgggactctccgccaggcgcccagaccggcaggtcccgcaggcggcgcgcggtgtgtttgcactttccaaagttcttgaaccatctcaagaactccttctgcatcttggcgtctggcaggggtgttccgagagaggtagacctcccctccccaaactgccaccatcacttccaacgccctccacgcgctggagctctgcccgggtgtggaaacctcgtcttccaacacgtagctgcccttcagccacccgcccgcagcctgggagtgccctgagggtgggtcgggggagctgcgcagggacatctctacaccgttcccatccgggaacagggcaacatctacaagcccaacaacaaggccatggcagacgagctgagcgagaagcaagtgtacgacgcgcacaccaaggagatcgacctggtcaaccgcgaccctaaacacctcaacgatgacgtggtcaagattgactttgaagatgtgattgcagaaccagaagggacacacagttttgacggcatttggaaggccagcttcaccaccttcactgtgacgaaatactggttttaccgcttgctgtctgccctctttggcatcccgatggcactcatctggggcatttacttcgccattctctctttcctgcacatctgggcagttgtaccatgcattaagagcttcctgattgagattcagtgcatcagccgtgtctattccatctacgtccacaccgtctgtgacccactctttgaagctgttgggaaaatattcagcaatgtccgcatcaacttgcagaaagaaatataaatgacatttcaaggatagaagtatacctgattttttttccttttaattttcctggtgccaatttcaagttccaagttgctaatacagcaacaatttatgaattgaattatcttggttgaaaataaaaagatcactttctcagttttcataagtattatgtctcttctgagctatttcatctatttttggcagtctgaatttttaaaacccatttaaatttttttccttacctttttatttgcatgtggatcaaccatcgctttattggctgagatatgaacatattgttgaaaggtaatttgagagaaatatgaagaactgaggaggaaaaaaaaaaaaaagaaaagaaccaacaacctcaactgcctactccaaaatgttggtcattttatgtgccattcacttcataatccagtaggatccagtgatccttacaagttagaaaacataatcttctggtgcctgaatatttgttatgtagataacaagacctcagtgccttcctgtttttcacattttccttttcaaatagggtctaactcagcaactcgctttaggtcagcagcctccctgaagaccaaaattagaatatccatgacctagttttccatgcgtgtttctgactctgagctacagagtctggtgaagctcacttctgggcttcatctggcaacatctttatccgtagtgggtatggttgacactagcccaatgaaatgaattaaagtggaccaatagggctgagctctctgtgggctggcagtcctggaagccagctttccctgcctctcatcaactgaatgaggtcagcatgtctattcagcttcgtttattttcaagaataatcacgctttcctgaatccaaactaatccatcaccggggtggtttagtggctcaacattgtgttcccatttcagctgatcagtgggcctccaaggaggggctgtaaaatggaggccattgtgtgagcctatcagagttgctgcaaacctgacccctgctcagtaaagcacttgcaaccgtctgttatgctgtgacacatggcccctccccctgccaggagctttggacctaatccaagcatccctttgcccagaaagaagatgggggaggaggcagtaataaaaagattgaagtattttgctggaataagttcaaattcttctgaactcaaactgaggaatttcacctgtaaacctgagtcgtacagaaagctgcctggtatatccaaaagctttttattcctcctgctcatattgtgattctgcctttggggacttttcttaaaccttcagttatgatttttttttcatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaaatgtaaagatattt

SEQ ID NO: 687 - DNA, 7028 bp, Homo sapiens
gcgggcgggcatctctgccgaaaacacctacagcgcccgctccctcggtccttcgagcagtgatccctccgcggccaacctccccagggaaaccagcgattcgcggttcagatagcgaccttcgcccgcaggttcctgctctgccttcagacttcggcttcagtggcacctgctcagcgaggcctcgtctaaccaagccatccgaattaactacccactcactcgccatcacatcaccccgatttaattcgcagcggggcactgactttacactcgtgtgtcttctgtgtttatttatggtctgtttctggaatgtccgctcctgggactgggaccatgattttctggcgcagtgcgggtgtctcggcgtccgggatcgggcgggtcgcagtagggctccacatttgttgagtgactgaacaccgttcccggccggggagagcgccgcagccgggtccacttcaggtaggggctgggctttcccggccccgcctaggccccgcccccagcgcgaacccgctcccacctcgcctgtccacggagcagcagggggtttgactgtgcttttccctcttgcttccctcgctctttctgcagctgccacgaaaacccggaacggcggagcggcgccgcccctcgcggcacctccctggcagcccttggaggccgcgctgggcatgctcagtcagctgggccgcctcagctctcggagtaggaagctcgggcgctccggctgtaaggagccgcggcggggggaaaatggagcccttcaccaatgatcggcttcagctccccaggaatatgattgaaaacagcatgtttgaggaagaaccagatgtggtggatttagccaaagagccttgtttacatcctctagagcctgatgaggtggaatatgagccccggggttcccgactgctggtgcggggtcttggtgagcatgagatggaggaggatgaagaggattatgagtcatcagcaaagctgctgggcatgtccttcatgaatagaagctcaggccttcggaacagtgcaactggttacaggcagagcccagatggggcttgttcagtaccctctgcaaggaccatggtggtctgtgcttttgtcatcgtggttgctgtttctgtaatcatggtgatttacttactgcccagatgtacctttaccaaagaaggctgccataaaaaaaaccagtcaattggactaattcagccatttgcaacaaatgggaaattgtttccatgggcacagatcaggcttcccactgccgttgtgccactacgctatgaactcagcctacacccgaacctaacctcgatgacattcaggggttctgtgacaatttcagttcaggctcttcaggtcacatggaatatcattcttcatagcacaggtcataatatttcaagagtgacctttatgtcagcagtttcaagccaagaaaaacaagctgagatcctggaatatgcatatcatggacagatcgccattgttgcccccgaagcccttctagcagggcacaattatacgttgaagatagagtactcggcaaatatatctagttcttattatgggttttatggcttctcctacacagatgaaagtaatgagaaaaagtactttgcagcaactcagtttgaacccctggcagcaagatctgcttttccttgttttgatgaaccagcatttaaagccacttttatcatcaagatcataagggatgagcaatacaccgctttatcaaatatgcctaagaagtcatcagtcgttctagatgatggacttgttcaggatgagttttctgagagtgtgaagatgagcacttacttggttgctttcattgtgggagagatgaagaacctgagtcaggacgtaaatggaaccctggtttctatatatgctgtaccagaaaagattggtcaagttcattatgccttggaaacaactgtgaagcttcttgagttttttcaaaactactttgaaattcagtacccacttaagaaattggatttggtggctattcctgactttgaagcaggagcaatggaaaattggggtttgctcaccttccgagaggagacacttctgtatgacagtaacacttcttcaatggcggatagaaagctggtgactaaaatcattgctcatgagctggcccaccagtggtttggcaatctggtaacaatgaagtggtggaatgacctatggctaaatgaaggttttgccactttcatggagtatttctctttggaaaaaatattcaaagagctttctagttatgaagatttcttagatgctcgatttaaaaccatgaagaaagattccttaaattcatctcatccaatatcatcatctgttcagtcttcagaacaaattgaagaaatgtttgattctctttcctattttaagggatcttctctcttgttgatgttgaaaacttaccttagtgaagatgtgtttcaacatgctgttgtcctttacctgcataatcacagctatgcatctattcaaagtgatgatctgtgggatagttttaatgaggtcacaaaccaaacactagatgtaaagagaatgatgaaaacctggaccctgcagaaaggatttcctttagtgactgttcaaaagaaaggaaaggaactttttatacaacaagagagattctttttaaatatgaagcctgaaattcagccttcagatacaagctacctgtggcatattccactatcctatgtcactgaaggaagaaattattcaaaatatcaatcggtatcattactggataagaaatcaggtgtcatcaatcttacagaagaagtgctgtgggtcaaagtgaatataaacatgaatggttattatattgtacactatgcagatgatgattgggaagcactaatccatcagttgaaaataaatccttatgttctgagtgacaaagaccgagccaaccttatcaacaacatctttgaacttgcaggcctaggcaaggtacctctcaagagggcctttgatttgattaattatcttggaaatgagaaccatactgcacccatcaccgaagccctgtttcagacagacctcatctataacctccttgaaaaactgggatacatggatctggcctcaagactggtgactagggtatttaaattacttcaaaaccaaattcaacaacaaacttggactgatgagggcactccatctatgcgagagcttcggtcagccctgctagagtttgcttgcacccacaacctggggaactgctctactactgccatgaaactgtttgatgactggatggcatccaatggaactcaaagcctacctactgatgtcatgacaactgtgttcaaagttggagcaaaaactgacaaaggctggtcattccttttgggcaaatacatttctataggctctgaagcagagaagaacaaaatactagaagcacttgccagctcagaggatgtgcggaagctttactggttaatgaaaagtagcctgaatggagataacttccgaacacagaagctgtcttttatcattagaacagtgggtcgacattttcctggacacttactggcatgggattttgtcaaagagaactggaataagcttgtacagaagttccctctggggtcctataccatacaaaatattgttgctggatcaacttacctgttttcaacaaagacacatttatctgaggttcaggcattctttgaaaatcagtcagaggcaaccttccggcttcgttgtgtccaggaggctttggaagtcattcagttgaatatccagtggatggagaagaacctcaaaagtctcacatggtggctgtagcatgcacaaccgcacctcattttgttgcccattcagagagcttgtaagcttgggctctgccgcttttgcaaaagccaaggtaaagccaggatcgctgccaagttgtttgcactctttggagttctagttagctcagggcctgactgtatttttcatccatcttttctgaagtgtctttgggcagtatgtagttatttattacaaaattatattcacgtaaatgccaaccatctacaaaaacaatgagtaatttttctactttgaagatacacagatggggacaaaaaccctgttttggaattctgttctattcctcagtatccagaaagttactgacacagtaaaacaaggaaagttctaccctaagagccgccatcacttcaggccgctggtttgtcagccatctgttgcttcttattgatagatggcattggaatgtggtacaaagttagctctgaagaatatggtaacgaagacaataaagcatgcactgtaagaactgacctcaggtgtgcagatctactttgatttggggttttgattaattctttatttttctgaaaaaaagtttaaataatgtctgtaactattgtgtttttttcctgccgaatagccaggtgctacagatttttaaaatttttgttgtattgaaaagctaaacaaggccaaaaggttaaattttttgaatatttaagactttctttttcatcttttatagcgttaccataggaaactgttccaaactgagttagctttaattataattattttattcataaatggtgatagtccccagatctgtacacctttatcactccctgccgtagatatactttaggttagtatttctacattcgtggcaagcattttggtaacaccagtggttttcattgtgacttttatcactatcactaagaatgcaatttaagttgccttttggcatcatagatcatagaaactttctctctgaatcatacccatgtgtgaattttcattttatatgatagtgtagcatattagaagcatattttaaaacagagcctttgagaaattgaaaaacaattatttgaagttcaccatagtaccttaaaggaacaaagagaatgtgggataggagtaacttgaattcgtgtttagtatggtgggctttgaatttttttcactatcaaaaatagtgcttttgtttagttaaaaattgtagtttttctttttttgtgtgtccaaactaacataaaaggagtggtcaaagaaggaaagaagaaaaatgagggaggatgtccgaaactgtatggcattttactccttctgaaagagaaatactgtacttgaatttttgagctatgcagacttatacctagattgttgtgtttctttgattcttaggagaaaagctttcttcctaataattcttgagaactttatattttgtttgaaaacagtttctatgtacataaaaagggtatttacccatttgtgagcacttaaaacactccacagagtcagacagtgggaaaggtcaccctttttttattcggcaggtatcaagttagaatgtatggaattgtgaataaaattatattttattttatgaaaatatttttatataataaaatttaaaaggctggtaagctaaaaaaatagtcttctttaatcctagtgtgttttccccaatttagtcttttctaaaatttatctgttttagagtagaaaatattatatcctgagaatcacagaatcatctaaatatgtcttattcaactgaagtgattgtaagtctttattcttgtgctttggttaaatgaatgataatttagttgatagtgaaagttaatgtgtttttatatttttagagtgagggaaaaatactaaacttttgagagttttgttgtcgttgctggttttttaccatgtggtactaaattccactttgatacaaaatttaaattttgtaacttctcaaaatcacttaagattcttcagttttacctgtgcttcttgacatcgctcctataatgtatgttagttaactctgcatatggcaaatcttgtcttgaattatatcatttctctccctctctctctctctctctgtgtgtgtgtgtgtgtgtgtgtgtgtgtgtgtgtgtgtgtagtgtggggggtattgttatgagtaaaactttatcaaaacttggcctgaaaaagagataactcatgatccattgctatctttattactcaaaggctgttcattcccataataccagatccataatagttgtagtttttttgatgttgttgcccttaccttaattatttgtagttttagtaggccttgcctcagtttttcccacagaattccataattttaatgttgaactaacccatctatataggacttctaaaaactacgtcaggaatgtaaggttaaatgagaggtagaacttgtagtgtaataggtataatggtagctttcaaagttttatcttctcaaaacattgtcttagccagtgtatttctgagaactcagactgaagcacagaagtcacagtatgcttcttttatttaagcacacagattcatgacacaagtacttgttgaacaagtgttctcattgcagagagatctacttgaatataaaagggtcatcatactagattattaaaaaagaattggaaatcttgagttgtggaagaaatgtttatgctttggagatctaaaaaagttatgaatgtaggaattagataagtccagtttgttctgttaatataaaatggttagatatattaaactgcaagtagtatcagcttcaccataagcttgggccttcctccatcttgttttatttaagtctctttaaatgaaattttgttgtcattgtttcagcattcatgaactttcttactatcacaggttctactttaattttccttgccatatgtgtttccattttgtgggacattagccaccacaggaacacaagagttgtcagaagactcctgggtgtacagagcaaatcaagctgcatcagtattataggataccaaacagaatcctttctattaggaaataagaaatcagttaagtgttggctgggcgcggtggcttatgcctgtaatcccagcattttgggatgccaaggtgggcagaccatttgaggccaggagttctaaaccagtttggccaacatggcaaaaccccatctctactaa

SEQ ID NO: 688 - DNA, 5346 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 689 - DNA, 5476 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggtttcttcaagagaaataagaaagatcattatgatgccacatatcacaaggctgagatccatgctcagccatctgataaagagaggcttacttctgatgcatagtattgatctacttctgtaattgtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 690 - DNA, 5463 bp, Homo sapiens
gcggccgctgcaggtccccgctcccctccccgtgcgtccgcccatggccgccgccgggcagctgtgcttgctctacctgtcggcggggctcctgtcccggctcggcgcagccttcaacttggacactcgggaggacaacgtgatccggaaatatggagaccccgggagcctcttcggcttctcgctggccatgcactggcaactgcagcccgaggacaagcggctgttgctcgtgggggccccgcgggcagaagcgcttccactgcagagagccaacagaacgggagggctgtacagctgcgacatcaccgcccgggggccatgcacgcggatcgagtttgataacgatgctgaccccacgtcagaaagcaaggaagatcagtggatgggggtcaccgtccagagccaaggtccagggggcaaggtcgtgacatgtgctcaccgatatgaaaaaaggcagcatgttaatacgaagcaggaatcccgagacatctttgggcggtgttatgtcctgagtcagaatctcaggattgaagacgatatggatgggggagattggagcttttgtgatgggcgattgagaggccatgagaaatttggctcttgccagcaaggtgtagcagctacttttactaaagactttcattacattgtatttggagccccgggtacttataactggaaagggattgttcgtgtagagcaaaagaataacactttttttgacatgaacatctttgaagatgggccttatgaagttggtggagagactgagcatgatgaaagtctcgttcctgttcctgctaacagttacttaggcctgctgtttttgaccagcgtttcctatacagatcctgatcagtttgtttataaaacacggcctccccgggagcagcctgacacattccctgatgtgatgatgaatagctacctaggtttttctttggactcagggaaaggtattgtttctaaagatgagatcacttttgtatctggtgctcccagagccaatcacagtggagccgtggttttgctgaagagagacatgaagtctgcacatctcctccctgagcacatattcgatggagaaggtctggcctcttcatttggctatgatgtggcggtggtggacctcaacaaggatgggtggcaagatatagttattggagccccacagtattttgatagagatggagaagttggaggtgcagtgtatgtctacatgaaccagcaaggcagatggaataatgtgaagccaattcgtcttaatggaaccaaagattctatgtttggcattgcagtaaaaaatattggagatattaatcaagatggctacccagatattgcagttggagctccgtatgatgacttgggaaaggtttttatctatcatggatctgcaaatggaataaataccaaaccaacacaggttctcaagggtatatcaccttattttggatattcaattgctggaaacatggaccttgatcgaaattcctaccctgatgttgctgttggttccctctcagattcagtaactattttcagatcccggcctgtgattaatattcagaaaaccatcacagtaactcctaacagaattgacctccgccagaaaacagcgtgtggggcgcctagtgggatatgcctccaggttaaatcctgttttgaatatactgctaaccccgctggttataatccttcaatatcaattgtgggcacacttgaagctgaaaaagaaagaagaaaatctgggctatcctcaagagttcagtttcgaaaccaaggttctgagcccaaatatactcaagaactaactctgaagaggcagaaacagaaagtgtgcatggaggaaaccctgtggctacaggataatatcagagataaactgcgtcccattcccataactgcctcagtggagatccaagagccaagctctcgtaggcgagtgaattcacttccagaagttcttccaattctgaattcagatgaacccaagacagctcatattgatgttcacttcttaaaagagggatgtggagacgacaatgtatgtaacagcaaccttaaactagaatataaattttgcacccgagaaggaaatcaagacaaattttcttatttaccaattcaaaaaggtgtaccagaactagttctaaaagatcagaaggatattgctttagaaataacagtgacaaacagcccttccaacccaaggaatcccacaaaagatggcgatgacgcccatgaggctaaactgattgcaacgtttccagacactttaacctattctgcatatagagaactgagggctttccctgagaaacagttgagttgtgttgccaaccagaatggctcgcaagctgactgtgagctcggaaatccttttaaaagaaattcaaatgtcactttttatttggttttaagtacaactgaagtcacctttgacaccccagatctggatattaatctgaagttagaaacaacaagcaatcaagataatttggctccaattacagctaaagcaaaagtggttattgaactgcttttatcggtctcgggagttgctaaaccttcccaggtgtattttggaggtacagttgttggcgagcaagctatgaaatctgaagatgaagtgggaagtttaatagagtatgaattcagggtaataaacttaggtaaacctcttacaaacctcggcacagcaaccttgaacattcagtggccaaaagaaattagcaatgggaaatggttgctttatttggtgaaagtagaatccaaaggattggaaaaggtaacttgtgagccacaaaaggagataaactccctgaacctaacggagtctcacaactcaagaaagaaacgggaaattactgaaaaacagatagatgataacagaaaattttctttatttgctgaaagaaaataccagactcttaactgtagcgtgaacgtgaactgtgtgaacatcagatgcccgctgcgggggctggacagcaaggcgtctcttattttgcgctcgaggttatggaacagcacatttctagaggaatattccaaactgaactacttggacattctcatgcgagccttcattgatgtgactgctgctgccgaaaatatcaggctgccaaatgcaggcactcaggttcgagtgactgtgtttccctcaaagactgtagctcagtattcgggagtaccttggtggatcatcctagtggctattctcgctgggatcttgatgcttgctttattagtgtttatactatggaagtgtggattctttaaacgctctaggtacgatgacagtgttccccgataccatgctgtaaggatccggaaagaagagcgagagatcaaagatgaaaagtatattgataaccttgaaaaaaaacagtggatcacaaagtggaacgaaaatgaaagctactcatagcgggggcctaaaaaaaaaaagcttcacagtacccaaactgctttttccaactcagaaattcaatttggatttaaaagcctgctcaatccctgaggactgatttcagagtgactacacacagtacgaacctacagttttaactgtggatattgttacgtagcctaaggctcctgttttgcacagccaaatttaaaactgttggaatggatttttctttaactgccgtaatttaactttctgggttgcctttatttttggcgtggctgacttacatcatgtgttggggaagggcctgcccagttgcactcaggtgacatcctccagatagtgtagctgaggaggcacctacactcacctgcactaacagagtggccgtcctaacctcgggcctgctgcgcagacgtccatcacgttagctgtcccacatcacaagactatgccattggggtagttgtgtttcaacggaaagtgctgtcttaaactaaatgtgcaatagaaggtgatgttgccatcctaccgtcttttcctgtttcctagctgtgtgaatacctgctcacgtcaaatgcatacaagtttcattctccctttcactaaaacacacaggtgcaacagacttgaatgctagttatacttatttgtatatggtatttattttttcttttctttacaaaccattttgttattgactaacaggccaaagagtctccagtttacccttcaggttggtttaatcaatcagaattagagcatgggaggtcatcactttgacctaaattatttactgcaaaaagaaaatctttataaatgtaccagagagagttgttttaataacttatctataaactataacctctccttcatgacagcctccaccccacaacccaaaaggtttaagaaatagaattataactgtaaagatgtttatttcaggcattggatattttttactttagaagcctgcataatgtttctggatttcatactgtaacattcaggaattcttggagaaaatgggtttattcactgaactctagtgcggtttactcactgctgcaaatactgtatattcaggacttgaaagaaatggtgaatgcctatggtggatccaaactgatccagtataagactactgaatctgctaccaaaacagttaatcagtgagtcgatgttctattttttgttttgtttcctcccctatctgtattcccaaaaattactttggggctaatttaacaagaactttaaattgtgttttaattgtaaaaatggcagggggtggaattattactctatacattcaacagagactgaatagatatgaaagctgattttttttaattaccatgcttcacaatgttaagttatatggggagcaacagcaaacaggtgctaatttgttttggatatagtataagcagtgtctgtgttttgaaagaatagaacacagtttgtagtgccactgttgttttgggggggcttttttcttttcggaaatcttaaaccttaagatactaaggacgttgttttggttgtactttggaattcttagtcacaaaatatattttgtttacaaaaatttctgtaaaacaggttataacagtgtttaaagtctcagtttcttgcttggggaacttgtgtccctaatgtgtttagattgctagattgctaaggagctgatactttgacagtgtttttagacctgtgttactaaaaaaaagatgaatgtcctgaaaagggtgttgggagggtggttcaacaaagaaacaaagatgttatggtgtttagatttatggttgttaaaaatgtcatctcaagtcaagtcactggtctgtttgcatttgatacatttttgtactaactagcattgtaaaattatttcatgattagaaattacctgtggatatttgtataaaagtgtgaaataaattttttataaaagtgttcattgtttcgtaacacagcattgtatatgtgaagcaaactctaaaattataaatgacaacctgaattatctatttcatcaaacc

SEQ ID NO: 691 - DNA, 1427 bp, Homo sapiens
ctgggaatatgattatgcttaatctatgctcagttgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctg

SEQ ID NO: 692 - DNA, 1111 bp, Homo sapiens
cgcagttaggcagcagcagccgcggacgagtagccgccgtgggagggagccatgaagcattacgaggtggagattctggacgcaaagacaagggagaagctgtgtttcttggacaaggtggagccccacgccaccattgcggagatcaagaacctcttcactaagacccatccgcagtggtaccccgcccgccagtccctccgcctggaccccaagggcaagtccctgaaggatgaggatgttctgcagaagctgcccgtgggcaccacggccacactgtacttccgggacctgggggcccagatcagctgggtgacggtcttcctaacagagtacgcggggccccttttcatctacctgctcttctacttccgagtgcccttcatctatggccacaaatatgactttacgtccagtcggcatacagtggtgcacctcgcctgcatctgtcactcattccactacatcaagcgcctgctggagacgctcttcgtgcaccgcttctcccatggcactatgcctttgcgcaacatcttcaagaactgcacctactactggggcttcgccgcgtggatggcctattacatcaatcaccctctctacactccccctacctacggagctcagcaggtgaaactggcgctcgccatctttgtgatctgccagctcggcaacttctccatccacatggccctgcgggacctgcggcccgctgggtccaagacgcggaagatcccataccccaccaagaaccccttcacgtggctcttcctgctggtgtcctgccccaactacacctacgaggtggggtcctggatcggtttcgccatcatgacgcagtgtctcccagtggccctgttctccctggtgggcttcacccagatgaccatctgggccaagggcaagcaccgcagctacctgaaggagttccgggactacccgcccctgcgcatgcccatcatccccttcctgctctgagcgctcacccctgctgaggctcagcccctcaacccggtggcattctgggggaggagtggggcccacagctctccagcacccggaataaagcccgcctgccccagtcaaaaaaaaaaaaaaaaaaaaaaaaaaa

SEQ ID NO: 693 - DNA, 2207 bp, Homo sapiens
tataaaaatagctcttgttaccggaaataactgttcatttttcactcctccctcctaggtcacacttttcagaaaaagaatctgcatcctggaaaccagaagaaaaatatgagacggggaatcatcgtgtgatgtgtgtgctgcctttggctgagtgtgtggagtcctgctcaggtgttaggtacagtgtgtttgatcgtggtggcttgaggggaacccgctgttcagagctgtgactgcggctgcactcagagaagctgcccttggctgctcgtagcgccgggccttctctcctcgtcatcatccagagcagccagtgtccgggaggcagaagatgccccactccagcctgcatccatccatcccgtgtcccaggggtcacggggcccagaaggcagccttggttctgctgagtgcctgcctggtgaccctttgggggctaggagagccaccagagcacactctccggtacctggtgctccacctagcctccctgcagctgggactgctgttaaacggggtctgcagcctggctgaggagctgcgccacatccactccaggtaccggggcagctactggaggactgtgcgggcctgcctgggctgccccctccgccgtggggccctgttgctgctgtccatctatttctactactccctcccaaatgcggtcggcccgcccttcacttggatgcttgccctcctgggcctctcgcaggcactgaacatcctcctgggcctcaagggcctggccccagctgagatctctgcagtgtgtgaaaaagggaatttcaacgtggcccatgggctggcatggtcatattacatcggatatctgcggctgatcctgccagagctccaggcccggattcgaacttacaatcagcattacaacaacctgctacggggtgcagtgagccagcggctgtatattctcctcccattggactgtggggtgcctgataacctgagtatggctgaccccaacattcgcttcctggataaactgccccagcagaccggtgaccgtgctggcatcaaggatcgggtttacagcaacagcatctatgagcttctggagaacgggcagcgggcgggcacctgtgtcctggagtacgccacccccttgcagactttgtttgccatgtcacaatacagtcaagctggctttagccgggaggataggcttgagcaggccaaactcttctgccggacacttgaggacatcctggcagatgcccctgagtctcagaacaactgccgcctcattgcctaccaggaacctgcagatgacagcagcttctcgctgtcccaggaggttctccggcacctgcggcaggaggaaaaggaagaggttactgtgggcagcttgaagacctcagcggtgcccagtacctccacgatgtcccaagagcctgagctcctcatcagtggaatggaaaagcccctccctctccgcacggatttctcttgagacccagggtcaccaggccagagcctccagtggtctccaagcctctggactgggggctctcttcagtggctgaatgtccagcagagctatttccttccacagggggccttgcagggaagggtccaggacttgacatcttaagatgcgtcttgtccccttgggccagtcatttcccctctctgagcctcggtgtcttcaacctgtgaaatgggatcataatcactgccttacctccctcacggttgttgtgaggactgagtgtgtggaagtttttcataaactttggatgctagtgtacttagggggtgtgccaggtgtctttcatggggccttccagacccactccccacccttctccccttcctttgcccggggacgccgaactctctcaatggtatcaacaggctccttcgccctctggctcctggtcatgttccattattggggagccccagcagaagaatggagaggaggaggaggctgagtttggggtattgaatcccccggctcccaccctgcagcatcaaggttgctatggactctcctgccgggcaactcttgcgtaatcatgactatctctaggattctggcaccacttccttccctggccccttaagcctagctgtgtatcggcacccccaccccactagagtactccctctcacttgcggtttccttatactccacccctttctcaacggtccttttttaaagcacatctcagattacccaa

SEQ ID NO: 694 - DNA, 3724 bp, Homo sapiens
tatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcaggtacgtacatgagggccactgggcctcgcctgtttttacatttgtctgttgcttccctgcccactgcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtacttttcacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccagtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagca

SEQ ID NO: 695 - DNA, 2561 bp, Homo sapiens
gtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtacttttcacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccagtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagca

SEQ ID NO: 696 - DNA, 1763 bp, Homo sapiens
tatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagttacaaggcccacttctccctccgcaacctgcatgccttctctgtggagccgctgctcatctaccccacacactacacaggagacgatggctatg

SEQ ID NO: 697 - DNA, 3655 bp, Homo sapiens
tatgacccctttaaggcgcggccagagtcctcccgcagaaaaacgacttaaaggagacgcgtggcgcgatggcggcggccccacgcgcgggccggcggcgcgggcagccgctcctggcgctgctgcttctgctgctggcgccactgccgccgggggccccgccgggcgccgacgcctacttccccgaggagcgctggagcccggagtcgcccctgcaggcgccgcgcgtgctcatcgcgctgttggcgcgaaacgcggcccacgcgttgcccaccacgctgggcgcactcgagcggctgcggcacccgcgggagcgcacggcgctatgggtggctacggaccacaacatggataacacgtcaactgtgctgcgggagtggctggtggccgtgaagagtttgtaccattccgtggagtggcggccagcagaggagcccaggtcctacccggacgaggaaggcccgaaacactggtctgactcacgctacgagcatgtcatgaagttgcgccaggcagccctgaaatcagctcgagacatgtgggctgattacatcctgtttgtagatgcggacaacctgatcctcaaccctgacacactgagcctgctcatcgctgagaacaagacggtggtcgcccccatgctggattcccgggctgcgtactccaacttctggtgtggaatgacttcccagggctactacaagcgcacacctgcctacatccctatccgcaagcgagaccgccggggctgctttgcagttcccatggtgcactcgaccttcctgatcgacctgcggaaggcggcgtccaggaacctggccttctacccacctcaccctgactacacctggtcctttgacgacatcatcgtctttgccttctcctgcaagcaggcagaggttcagatgtatgtgtgcaacaaggaggagtacggattcttgccagtgccattgcgcgcccacagcaccctccaggatgaggccgagagcttcatgcatgtgcagctggaggtcatggtgaagcacccgcccgcagagccctcccgcttcatctcggctcccaccaagacaccggacaagatgggcttcgacgaggtcttcatgatcaacctgaggcggcggcaggaccggcgggagcgcatgctgcgggcgctgcaggcacaggagatcgagtgccggctggtggaggccgtggacggcaaagccatgaacaccagccaggtggaggcgctggggatccagatgctgcctggctaccgggacccctaccacggccggcccctcaccaagggtgagctgggctgcttcctgagccactacaacatctggaaggaggtggtggaccgggggctgcagaaatcgcttgtgtttgaggatgacctgcgttttgagatcttcttcaagagacgtctgatgaacctcatgcgggatgtggagcgggagggcctggactgggacctcatctatgtgggccggaagcggatgcaggtggagcaccccgagaaggctgtgcctcgcgtgaggaacctggtggaggccgactattcctactggaccctggcctacgtgatctccctgcaaggcgcccgcaaactgctggctgctgagccgctctccaagatgctgcctgtggacgagttcctgcccgtcatgttcgacaaacacccagtgtccgagtacaaggcccacttctccctccgcaacctgcatgccttctctgtggagccgctgctcatctaccccacacactacacaggagacgatggctatgtgagtgacaccgagacctcagtcgtatggaacaatgagcacgtcaagaccgactgggaccgcgccaagtcccagaagatgcgggagcagcaggcactgagccgtgaggccaagaactcggacgtgctccagtccccactggacagtgctgcccgggatgaactctgaggggtagcagccagaaagccaaagcagccatcggtggcccaggctccacgtgcttactgaggacatcagggccacctctggaccccttggcaggccacagagggctctcgtgtggggtggtgtccagccagctcttgctaagcaatcacgtgcacacaggcagcattaatggagtgcctactgcatgccagcaacagggcttggccctggggaattgggaggaaccaagccctcttcatctgttcatgtgcccagcatttattaagcacctgctgtatgcaaggttcccatgttacggcagtgaatgaggcataattgttccctccatcagcgattgattcagtcatcaagcagttactgatcagattaagaatcaggcactagtgatacacattcatttttaaaattcattcaaggatttattgagtgcctactgtgtgttgggtgccattccaggctctgggatttttttttttttttttttaagagtagagtctgtctctgtcacccaggctggagtgcagtggtgtgacggctcactgcagcctgcgcctcccagcgtccagcaattcttgtttctcggcctcccaagtagctgggactataggtgcgtgccatcacatctggctagtttttgtatttttagtagagacggggtttcaccatgttggccagactggtctcgaactcctgacctcaagtgatctgcccgccttggccacccaaagtgctagggttacaggcatgagccactgtgcccagcccaggctctgggaatattgagataaataagatgcttctatccatttattcaagcacatattggtcacctactgtgtgcctggcactcatgtcacaaagataagttcctgattcggtacacttactgagcacctgctgtgtgcagggagctgagctatgggatgggaatgggagtaaacaaggtacttttcacttttttctttttttcctcactgctagacggtgtgggaacttctcactcattggcttctttcccacacacctgaagagcactgactgtgtgccgggcactagtgatacaaaagagtgtgacagttgttcagtctgcattttcgatcatgggctacatgccgagtgctggggcacagagatgaacaagatcggttccttcacttcttcatgccacaagtgtttattgagcacctgtgtgccaggcctcacagactcccagttgggttgaagaatggttgactgagtttgattcttcctgtaccctcggtcgtctgagctgtgtgcagacaacatccccccaccacccaagagggagggtagctcttccgccaccaggggcaagcacaggtcctggtggccccacgccacatgttagcccccctggagggggcgccagttggagacgggggctgggtgtccctggcccactcccagtcccctgtgctttacctccttgcccttgtgtctcaggtgtggtccctgcctgcttgatgaagttgctctgttcaagcctttggtgggatcatgtgtttgggggcttttaggggacccagctgcactggggcactgcccgtggcctgggtaggacatttcccagcaagggctggaggagttgccgtgccttcagcctgaatcgaatgtcagaaccagccagcggtgcttcaccctcttggggataacttgcttagttttttaataaatgttcctggttggttttcacagca

SEQ ID NO: 698 - DNA, 4509 bp, Homo sapiens
gcgggcggagcgggaggcggccacgtccccggcgggcctgggcgcggggaggcccggccccctgcgagcgcgccgcgaacgctgcggtctccgcccgcagaggccgccggggccgtggatggggagggcgcgccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaatgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgac

SEQ ID NO: 699 - DNA, 11116 bp, Homo sapiens
gaaattttaatttattattcccccctttttttcctgcatctataggataatattgtaaaatagcaattgaaaccaataatcattaaataaatatcaaggaaaatccaagcaaagctttctttttgttggactagtggtgtggtgtttggagacagtctctgaatgtgaacaggaaagcacccatcagcaaaacacgatcactctctagggagacagctgggggaatctgactctggcttctgcttttgttttaagggattaacttccctgtcaagtccaagaagacttgcgtatgagaagattacctgatggacttaattctaagattagcttttttcatcaagatggaaaaagatctttaggagcagaaaaggggagtgctaactgggggagcgagaagggagacgagcaaaagaaacaaaatcttgccacgtggctctgttttgtcagcaagaggatttaagactcacccagggcaaacactgggaccactgtaagagcgctggaacattctgcctcttgagtgaaggggccttctttctagcctctatggcactgaggggtgcgccggctggtggaggagtagtccgatggagccctgcgttccccggggacacagggccaagctttgaggtggaaagtttctggttctgaaacaacaaggagagagtctgtttttcttcctaaaatttggactcttgtctgcacaaactctggtctgttttgcacggtttgtgtgcctttttttccctttatgcaatctttttcagctttagcagcagaaatttgtctagttcaggaaacatgctagagggtggcttcagaaggaagatgatcctgtgtattctgtctctgcatccgaacttttgaagagaaaaattcgagctagagggattcttaaagccttaagttacttgaaatctatgtatttgcaaccctttgtctctggaatcatattacactaaactggaatctcaggctgaatgagaataaccaagtggagtaaaaagaagaaaaccgtttcttgatcaccacttaattaacgatgctctttctccaaaggatcagcacgttcttcctctgagaacttgaaaatacaaatggaccccatgtttttttaagcattaccttttcttagaagactgccatcatcttttatagaggaattttttcactatgcattcggtggatctttataaaatactgaccttctaattagattcaggtcagtcttaattaaagggggaaaaaagcaacgcaagccaaccacaaaaacacatataccaatgaaagaaattggtttaaatttcacagcattaacattactttttaagtaaaacagttcattgaagaaagtatgtatgcagcagtggaacatgggcctgtgctttgcagtgactccaacatcctgtgcctgtcctggaaggggcgtgtccccaagagtgagaaggagaagcctgtgtgcaggagacgctactatgaggaaggctggctggccacgggcaacgggcgaggagtggttggggtgactttcacctctagtcactgtcgcagggacaggagtactccacagaggataaatttcaacctccggggccacaatagcgaggttgtgctggtgaggtggaatgagccctaccagaaactggccacgtgcgatgcggacggaggcatattcgtgtggattcagtacgagggcaggtggtctgtggagctggtcaacgaccgcggggcgcaggtgagtgatttcacgtggagccatgatggaactcaagcacttatttcctatcgagatgggtttgtcctggttgggtctgtcagtggacaaagacactggtcatccgaaatcaacttggaaagtcaaattacgtgtggcatatggactcctgacgaccaacaggtgctgtttggcacggccgatgggcaggtgattgtcatggattgccacggcaggatgctggcccacgtcctcttgcacgagtcagacggtgtcctcggcatgtcctggaactacccgatcttcctggtggaggacagcagcgagagcgacacggactcagatgactacgcccctccccaagatggtccggcagcatatcccatcccagtgcagaacatcaagcctctgctcaccgtcagcttcacctcgggagacatcagcttaatgaacaactacgatgacttgtctcccacggtcatccgctcagggctgaaagaggtggtagcccagtggtgcacacagggggacttgctggcagtcgctgggatggaacggcagacccagcttggtgagcttcccaatggtccccttctgaagagtgccatggtcaagttctacaatgttcgtggggagcacatcttcacactggacactctcgtgcagcgccccatcatctccatctgctggggtcaccgggattcgaggctgttgatggcatcaggaccagccctgtacgtggtgcgtgtggagcaccgggtgtccagcctgcagctgctgtgccagcaggccatcgccagcaccttgcgtgaggacaaggacgtcagcaagctgactctgcccccccgcctctgctcctacctctccactgccttcatccccaccatcaagcccccaattccagatccgaacaacatgagagactttgtcagctacccatcagccggcaacgagcggctgcactgcaccatgaagcgcacagaggacgacccggaggtgggcggcccgtgctacacgctctacctggagtacctgggcgggcttgtgcccatcctcaaagggcggcgcatcagcaagctgcggccagagttcgtcatcatggacccgcggacagatagcaaaccagatgaaatctatgggaacagcttgatttctactgtgatcgacagctgcaactgctcagactccagtgacattgagctgagtgatgactgggctgccaagaaatctcccaaaatctccagagctagcaaatcacccaaactcccaaggatcagcattgaggcccgcaagtcacccaagctgccccgggctgctcaggagctctcccggtccccacggttgcccctgcgcaagccctctgtgggctcgcccagcctgactcggagagagtttccttttgaagacatcactcagcacaactatcttgctcaggtcacgtctaatatctggggaaccaaatttaagattgtgggcttggctgctttcctgccaaccaacctcggtgcagtaatctataaaaccagcctcctgcatctccagccgcggcagatgaccatttatctcccagaagttcggaaaatttccatggactatattaatttacctgtcttcaacccaaatgttttcagtgaagatgaagatgatttaccagtgacaggagcatctggtgtccctgagaacagcccaccttgtaccgtgaacatccctattgcaccgatccacagctcggctcaggctatgtcccccacgcagagcatagggctggtgcagtccctactggccaatcagaatgtgcagctagatgtcctgaccaaccagacgacagctgtagggacagcagaacatgcaggtgacagtgccacccagtacccagtctccaaccggtactccaatcctggacaggtgattttcggaagcgtggaaatgggccgcatcattcagaacccccctccactgtccctgcctcccccgccgcaggggcccatgcagctgtccacggtgggccatggagaccgagaccacgaacacctgcagaagtcagccaaggccctgcggccaacaccgcagctggcagctgagggggacgcagtggtctttagtgccccccaggaggtccaggtgacgaagataaaccctccacccccgtacccaggaaccatccccgctgcccccaccacagcagcacccccgccccctctgccgcccccacagcccccagtggatgtgtgcttgaagaagggcgacttctccctctaccccacgtcagtgcactaccagacccccctgggctatgagaggatcaccaccttcgacagcagtggcaacgtggaggaggtgtgccggccccgcacccggatgctgtgctcccagaacacctacaccctccccggcccgggtagctctgccaccttgaggctcacggccactgagaagaaggtccctcagccctgcagcagtgccaccctgaaccgcctgaccgtccctcgctactccatccccaccggggacccacccccgtatcctgaaattgccagccagctggcccaggggcggggggctgcccagaggtccgacaatagcctcatccacgctaccctgcggaggaacaaccgtgaggctacgctcaagatggcccagctggccgacagcccgcgggcccccctgcagcccctggccaagtccaagggcgggcccgggggggtggtgacacagctcccagcgcggcccccacctgccctgtacacctgcagtcagtgcagtggcacagggcccagctcacagcccggagcctccctggcccataccgccagcgcctccccgttggcctcccagtcctcctacagcctcctgagcccacccgacagcgcccgcgaccgcaccgactacgtcaactcggccttcacggaggacgaggccctgtcccagcactgtcagcttgagaagcccttgaggcaccctcccctgcctgaagctgctgtcaccctgaaacggccacccccttaccagtgggaccccatgctgggtgaggacgtttgggttcctcaagaaaggacagcacagacttcagggcccaaccccttaaaactgtcctctctgatgctgagtcagggccagcacctggacgtgtcccgactgcccttcatctcccccaagtctcctgccagccccactgccactttccaaacaggctatgggatgggagtgccatatccaggaagctataacaacccccctttgcctggagtgcaggctccctgctctcccaaagatgccctgtccccaacgcagtttgcacaacaggagcctgctgtggtccttcagccgctgtacccacccagcctctcctattgcaccctgccccccatgtacccaggaagcagcacgtgctctagtttacagctgccacctgtcgccttgcatccatggagttcctacagcgcctgcccgcccatgcagaacccccagggcactctccccccaaagccacacttggtggtggagaagccccttgtgtccccaccacctgccgacctccaaagccacttgggcacagaggtgatggtagagactgcagacaacttccaggaagtcctctccctgaccgaaagcccagtcccccagcggacagaaaaatttggaaagaagaaccggaagcgcctggacagccgagcagaagaaggcagcgttcaggccatcactgagggcaaagtgaagaaggaggctaggactttgagtgactttaattccctaatctccagcccacacctggggagagagaagaagaaagtgaagagtcagaaagaccaactgaagtcaaagaagttgaataagacaaacgagttccaggacagctccgagagcgagcctgagctgttcatcagcggggatgagctcatgaaccagagccagggcagcagaaagggctggaaaagcaagcgctccccacgggccgccggcgagctggaggaggccaagtgccggcgggccagtgagaaggaggacgggcggctgggcagccaaggcttcgtgtacgtgatggccaacaagcagccgctgtggaacgaggccacccaggtctaccagctggacttcggggggcgggtgacccaggagtccgccaagaacttccagattgagttagaggggcggcaggtgatgcagtttggacggattgatggcagtgcgtacattctggacttccagtatccgttctcagccgtgcaggcctttgcagttgccctggccaacgtgactcagcgcctcaaatgaagagactggtgtggggaggagagagatgcagagagcctttggaagaggtcttcggagatgccagaggagccctctaggggtccgatgcctgggaggaccagaagccaacagcaaaactggaaaagcccggcaggcccaggagagggcgctgacctgtggtcgtcatttatttggttgggttttattaccttttattgtctgttcttcttttcttctttcatttcagtggcatttggaagcaaagagtgctaggcacctgctgttctttcaggaaacagcttggctgtggtaatgctctactgggcccttcagaatgaagacagtctgccttagagcctgctattcttttagacatagggaggatgcattatcctgtattctcctccaacatcaccactagcgtaaaagcaaaaagcttttacaaaacacagccaaaaattctcaagatgcaggttcttggggaatgggatggggacagcatttgatttacactgattatgttactccccaaaaggtgacttaattaataaagggcatttgggcagacacactgtgttggaccaacaaagtaggctctttacaggggtgttctcaccaggtagaaatgcgatttgctcactgaggatgttggggaagggacgaagggtaaagaagaaactgcacgtatacacaggttcacatcactctgcagacagcaatgtgactcagcgtgtgacttgtagcagcagtacgagggctacactcctctgctgaggatgtctacattgaaagcctccactagtttcatcgtttgtcaaagttccgtaggatcagtgatggtcattcagcatgactggttctgggagaaggtgagagacaaaaatggaaagatcctggcctgtggtagtggtagcagttttctcaaataatgtggtgacagtcactagatcctcacatgctgagaaacagcctctactctctctgccccttttactttttaatctggaatgcattactgtaaacatgatctttcccatgagataccatgttctatgccttcccattctaaaagtgtggacaacgcttgatttgaaaccactccttttctcctcttggctacattaaaattcagttgactacaaatgctttctatcaaattagaaatgtaaccaaaaaaatgttaagtgttcaccagggtattaaaatacagaggagtatggtcaaatctttgacaaaattttcatgatcttctctaacaaaaaaagttgtttattaactgtacagactgtttactaaggagctaaaccactgagaaaacgttattaaaattgtaatacctaggtagttggttgatcacagtttgttaattgtataaaaaaaaattacctagaatatctcttcccacttcctcgtcctcgtgagaacctgtgggcagtattcaagccctgatgacaaaacccagtgttttttgttgttgttttttgttgttgttttttgtttttgtttttgtttttctcagtcttacctgtgatgttgtttaggatcaggcccctctcctgggcctgctgtgcaggagcacaggaactatctgctggcgttgggttccaaatttgcattttatttggaaacagacaagtagaagatgctacagaaaagtattttcaaatttaaacgttttttaatcccctgttttagttaaaaaattggaaaagaaaccgacccatttttttcccagatcaagatgacatgacatcactcccaattctctccaaaccccagagaaatactgacgaagttttctgatgtggcaaaggatatttcccatctaataccagtttctcatttatatttaacgtattggacctgatatttttagtgggtgcattcttccagaaagaattcagcaatgttatcagaattaattcttttatatgagtttatgtagcttgatatggtgtttcagtgcttattggttgtgcaataatggttatagcctgttagataatctaaatgcaattcccctgttttgtcgtttaggagataattatttatcttgcttttcatagtgttcttaggaattattttgttgttacgttttggtgagttatacccattttatttatttagaaaaatagtatctttgttaacgacttacatggtcacagtatattttgctgcaagaaataaagaggatatgatagaaggtttttttttttttttttttttttttttgagacggagtcccactcttgtcgcccaactagagtgtagtggcacaatctcggctccccacaacctctgactccagggttcaggtgattattttgcctcagcctcccaagcagctgggattatagacacccgccaacacgccaggctaatgtttttgtatttttaatagagatggggttttgccatgttggccaggctggtcttgaactcctgacctcaggtgatccgcccgcctcggcctcccaaagtgctgggattacagacgtgagccaccactcccggcccatagaaggttttttgctggataatttgtaacttttctaattgggaaaaaattcctattaatcacttaaaaatttttttttgtattttgtgttattgattatatacaaaggagactttttttttgagataacactcaaatagtattctcttcttttgaaaattttatttttatctgaaaataacagttgatctgaaataaaaaggggagacctattagaatgagagtagccaaggaaagagttactaggtaataagcttcactttttgtgttctaattgtttttgagatataaagaccctgaaaaagcccattttagaacctgtttaataagagcaaatataggggaaaatctttgaaatgaaagctacaaatacatgtgagaagaaaaaaatggatttttttagcaaataattaactaagcttctaaatgcctagctccctcccccaaaggcgctttcccccgatggaggcacaggcttctgtctcggatgtttggcgcacgtgagtttgtatgagtttgtaccggagtgaccccggcagccactgcccacctcccctctacccaggggcctgaaaagaggggctgccctcctgcgccaaggcagacacaagctgcgggctgtgcggtcctagtagtgtgacgtttcagttaatagtggtggtcttattttcaactatgctttcagtctctgttgactaaatacgacgaaaattcatactttatgcaggagatttctaaaaatttaatgtttattaatagtttatgaatatcaagatacctcattgaatccctaaatttaaaagcagtccagtaaaaggttaactgtataaagaatctatgactttttgagggaagtgtgatatattaacaaatataaccaattctaaatttgttttagctctaacctcatcaaaccaaaggcacagatttgtgtacaatatacccattgaatgtatatcctgagaaaaattggggccaaagaagcaggaaaatctcaaagctctaatggcagcataaatcaaagaatttcacaggctagtgtttttatccatagccattgctcccttgtcaagtgtctcacaaggacatggaagaatgtgttatgttcatcttgtaatcatagcaaaaagtctgcaaaccccagggtcaagcctgctctgccacagggttggatggtgaccttgggcaagtccctggggctggctaggcctccacttgtccatctgtgaaatgaaaggatcagcctggacagccctctaaactcccttacagctctcagcctaagagcgcagcactgaacagcctcatcattccacttttcatgggaaatatatttcacaccattgcctttgtgtagagaaatatttcttttcctgtgttaatgagctatgtactgaatataaaccagtgcatttaaagtaatatcttttgtgcacctctaaatgtgtttggaattgtgtttgttctcatagaatatacaaaagtactgattctaggtaagaaggagtctccacgggtgtgccctgctcagctggatgtccatgagaacagccatgaaataagtcactacttgtccccaaaaccacaggaatatatacctaggtcacctcaaattcctgagtgtgctctgccatgttacacggtcttcaaattgaaaaggtttcttgaaaaggaaagtttggcccagcaactggagaaggagtccatggtgtcgctgtgtgcctgtatcatttggccaagtcaatggttgtaagcaaagttagtggagacaaaaatgtgtccaaaatgtcgtttgagttcctgggatttctgtaatagcacacaactcagaactcttcagcatttgtgtgattccttacctctggctgataaaactctaatgggttgtggcttactttgtttccattttctttggctttgtgcaatttttgtgtaactttacttgtacctatattttctgtttacagttctttttaaggggaggggtagggttctaagatcttgttgtttattgtagataaaaattttttcgtgttgtagaaaagcatgggttatgcgtttgactgaaaaagacactgtattatttaccaaaggggtattgtttttgcatttgtttataaatgcattattttggtactgtaaatttggacataatttctgagtttattactactggcattttctttttccctttttttttttttttaaccgtaagtgcacgatgcaggtgcataggccccagaccaaactagaccaccagcatgttcatgtccagacctcggcagtggcgtgcactgcttgtgcacctcagttcctccagtgttggtttgtttgttttttaattcagcatcctgctggttttactttccaagcaagatctgttgcgactcccaaatgcgttttaatgagctcatccttatttgcctttcttcttacgtattttgtgtattagattgtgcaggagatattctagaaggcattaatggtttgcattcaaaacgatgtggtttgtccaagttattttctgtctttattactgagacggattaatctccttatttttttcttgatgatttgaagttgtaacagttgtccagctattgcttaataaaattttgcagatcaaaaaa

SEQ ID NO: 700 - DNA, 1743 bp, Homo sapiens
atgattatctcaatagatgcagagaaggcctttgacaaaattcaacagcccttcatgctaaaaactctcaataaattagggattgatgggacgtatctcaaaataataagagctatctatggcaaacccacagccaatatcatactgaatgggcaaaaactggaagcattccctttgaaaactggcacaagacagggatgccctctctcatcactcctattcaacatagtgttggaacttctggccagggcaatcaggcaggagaaggaaataaagggtattcagttaggaaaagaggaagtcaaattgtccttgtttgcagatggcatgattgtatatctagcaaaccccatcgtctcagcccaaagtctccttaagctgataagcaacttcagcaaagtctcaggatacaaaatcaatgtgcaaaaatcacaagcattcttatacgccaataacagacaaacagagagccaagtcatgagtgaactcccattcacaattgcttcaaagagaataaaatacctaggaatcgaacttacaagggatgtgaaggacctcttcaaggagaattacaaaccactgctcaatgaaataaaagaggatacaaacaaatggaagaacattccatgctcatggataggaagaatcaatattgtgaaaatggccatactgcccaagctgggtaagaattttctttgtataaatggtaaatccaggaaagagtacaagtttttgatctgtcactttcaaaactgccaagcacctcagcatttctatgagctttttagatcttctgccttgtcccaatctgaggacgctgaggaagagcttgcaagaaaagacggtctggagtggacctccaagcaaactccagcagacctgcagcagaggggcttaactgttagaagaaaaactaacaaacagaaaggaatagcatcaacatcaacaaaaaggatgtccatgcaaaaaccccatccaaacgtccctaacatcaaagaccaaagaattaggaaaaactacttcaaatttcatatggaaccaaaaaaagcccatatagccaagacaatcctaagcaaaaagaacagagctggaggcatcaagctacctgatttccaactatactacgaggctacagtaatcaaaacagcatggtactggtaccaaaccagatacatagaccaatggaacagaacaaaggcctcagaaataacatcacacatctacaaccatctgatctttgacaacccttacaaaaacaagcaatggggaaaggacttcctatttaataaatgctgttgggaaaactggctagccatgtgcagaaaactgaaactggaccccttctttacaccttacacaaaaattaactcaagatggaataaagacttaaagctaagacctaaaaccataaaaaccatagaagaaaacctatgcaataccattcaggacataggcatgggcaaggacttcatgactaaaacaccaaaagcaatggcaacaaaagccaaaattgacaaatgggttctaattaaactgaagatcttctgcacagcaaaagaaactattgcgggatctggccagcagcctgcaatgcactggggctctctctttgttcccaggtggatcggcaggtcgagaaataatagacacacacaagatagtgaaagctgggtccaggggggtaaccgccttctggtcacatggtgccgccaatgcactggatataccagcatttattactaa

SEQ ID NO: 701 - DNA, 6300 bp, Homo sapiens
gcgacggcggcggcagcggcggcggtgatggctcctccgggctgcccgggttcgtgccccaacttcgccgtagtctgctccttcttggagcgctacgggccgctgctagacctgcctgagttgccgttccctgagctggagcgggtgctgcaggcgccgccgccggacgtcggcaacggagaagtaccaaaagaattggtggagctccatttgaagctgatgaggaaaattggcaaatctgttactgcagacagatgggaaaaatatttgatcaagatatgccaagagtttaacagtacctgggcatgggagatggagaagaagggctatcttgaaatgagtgttgaatgcaaactagcactcttaaagtacctctgtgagtgtcagtttgatgacaatctcaaattcaagaatattattaatgaggaggatgccgatactatgcgtctccagccaattggtcgagacaaagatggcctcatgtactggtaccaattggatcaagatcacaatgtcagaatgtacatagaagaacaagatgatcaagatggctcttcatggaaatgcattgtcagaaatcgaaacgagttggctgagactcttgcactcctgaaagcacaaattgatcctgtactattgaaaaactctagccaacaagacaactcttctcgggaaagtcccagcttagaggatgaggagactaaaaaagaggaagaaacacctaaacaagaggaacagaaagaaagtgaaaagatgaaaagtgaggagcagcctatggatttagaaaaccgttctacagccaatgttctagaagagactactgtgaaaaaagaaaaagaagatgaaaaggaacttgtgaaactgccagtcatagtgaagctagaaaaacctttgccagaaaatgaagaaaaaaagattatcaaagaagaaagtgattccttcaaggaaaatgtcaaacccattaaagttgaggtgaaggaatgtagagcagatcctaaagataccaaaagtagcatggagaagccagtggcacaggagcctgaaaggatcgaatttggtggcaatattaaatcttctcacgaaattactgagaaatctactgaagaaactgagaaacttaaaaatgaccagcaggccaagataccactaaaaaaacgagaaattaaactgagtgatgattttgacagtccagtcaagggacctttgtgtaaatcagttactccaacaaaagagtttttgaaagatgaaataaaacaagaggaagagacttgtaaaaggatctctacaatcactgctttgggtcatgaagggaaacagctggtaaatggagaagttagtgatgaaagggtagctccaaattttaagacagaaccaatagagacaaagttttatgagacaaaggaagagagctatagcccctctaaggacagaaatatcatcacggagggaaatggaacagagtccttaaattctgtcataacaagtatgaaaacaggtgagcttgagaaagaaacagcccctttgaggaaagatgcagatagttcaatatcagtcttagagatccatagtcaaaaagcacaaatagaggaacccgatcctccagaaatggaaacttctcttgattcttctgagatggcaaaagatctctcttcaaaaactgctttatcttccaccgagtcgtgtaccatgaaaggtgaagagaagtctcccaaaactaagaaggataagcgcccaccaatcctagaatgtcttgaaaagttagagaagtccaaaaagacttttcttgataaggacgcacaaagattgagtccaataccagaagaagttccaaagagtactctagagtcagaaaagcctggctctcctgaggcagctgaaacttctccaccatctaatatcattgaccactgtgagaaactagcctcagaaaaagaagtggtagaatgccagagtacaagtactgttggtggccagtctgtgaaaaaagtagacctagaaaccctaaaagaggattctgagttcacaaaggtagaaatggataatctggacaatgcccagacctctggcatagaggagccttctgagacaaagggttctatgcaaaaaagcaaattcaaatataagttggttcctgaagaagaaaccactgcctcagaaaatacagagataacctctgaaaggcagaaagagggcatcaaattaacaatcaggatatcaagtcggaaaaagaagcccgattctccccccaaagttctagaaccagaaaacaagcaagagaagacagaaaaggaagaggagaaaacaaatgtgggtcgtactttaagaagatctccaagaatatctagacccactgcaaaagtggctgagatcagagatcagaaagctgataaaaaaagaggggaaggagaagatgaggtggaagaagagtcaacagctttgcaaaaaactgacaaaaaggaaattttgaaaaaatcagagaaagatacaaattctaaagtaagcaaggtaaaacccaaaggcaaagttcgatggactggttctcggacacgtggcagatggaaatattccagcaatgatgaaagtgaagggtctggcagtgaaaaatcatctgcagcttcagaagaggaggaagaaaaggaaagtgaagaagccatcctagcagatgatgatgaaccatgcaaaaaatgtggccttccaaaccatcctgagctaattcttctgtgtgactcttgcgatagtggataccatactgcctgccttcgccctcctctgatgatcatcccagatggagaatggttctgcccaccttgccaacataaactgctctgtgaaaaattagaggaacagttgcaggatttggatgttgccttaaagaagaaagagcgtgccgaacgaagaaaagaacgcttggtgtatgttggtatcagtattgaaaacatcattcctccacaagagccagacttttctgaagatcaagaagaaaagaaaaaagattcaaaaaaatccaaagcaaacttgcttgaaaggaggtcaacaagaacaaggaaatgtataagctacagatttgatgagtttgatgaagcaattgatgaagctattgaagatgacatcaaagaagccgatggaggaggagttggccgaggaaaagatatctccaccatcacaggtcatcgtgggaaagacatctctactattttggatgaagaaagaaaagaaaataaacgaccccagagggcagctgctgctcgaaggaagaaacgccggcgattaaatgatctggacagtgatagcaacctggatgaagaagagagcgaggatgaattcaagatcagtgatggatctcaagatgagtttgttgtgtctgatgaaaacccagatgaaagtgaagaagatccgccatctaatgatgacagtgacactgacttttgtagccgtagactgaggcgacacccctctcggccaatgaggcagagcaggcgtttgcgaagaaagaccccaaagaaaaaatattccgatgatgatgaagaggaggaatctgaggagaatagtagagactctgaaagtgacttcagtgatgattttagtgatgattttgtagaaactcggcgaaggcggtcaaggagaaatcagaaaagacaaattaactacaaagaagactcagaaagtgacggttcccagaagagtttgcgacgtggtaaagaaataaggcgagtacacaagcgaagactttccagctcagagagtgaagagagctatttgtccaagaactctgaagatgatgagctagctaaagaatcaaagcggtcagttcgaaagcggggccgaagcacagacgagtattcagaagcagatgaggaggaggaggaagaggaaggcaaaccatcccgcaaacggctacaccggattgagacggatgaggaggagagttgtgacaatgctcatggagatgcaaatcagcctgcccgtgacagccagcctagggtcctgccctcagaacaagagagcaccaagaagccctaccggatagaaagtgatgaggaagaggactttgaaaatgtaggcaaagtggggagcccattggactatagcttagtggacttaccttcaaccaatggacagagccctggcaaagccattgagaacttgattggcaagcctactgagaagtctcagacccccaaggacaacagcacagccagtgcaagcctagcctccaatgggacaagtggtgggcaggaggcaggagcaccagaagaggaggaagatgagcttttgagagtgactgaccttgttgattatgtctgtaacagtgaacagttataagactttttttccatttttgtgctaatttattccacggtagctctcacaccagcgggccagttattaaaagctgtttaatttttcctagaaaactccactacagaatgacttttagaagaaaaatttcaacaaatcctgaagtctttctgtgaagtgaccagttctgaactttgaagataaataattgctgtaaattccttttgattttctttttccaggttcatggtccttggtaatttcattcatggaaaaaaatcttattataataacaacaaagatttgtatatttttgactttatatttcctgagctctcctgactttgtgaaaaagggtggatgaaaatgcattccgaatctgtgagggcccaaaacagaatttaggggtgggtgaaagcacttgtgctttagctttttcatattaaatatatattatatttaaacattcatggcatagatgatgatttacagacaatttaaaagttcaagtctgtactgttacagtttgagaattgtagataacatcatacataagtcatttagtaacagcctttgtgaaatgaacttgtttactattggagataaccacacttaataaagaagagacagtgaaagtaccatcataattaacctaaatttttgttatagcagagtttcttgtttaaaaaaaaataaaatcatctgaaaagcatttgtacagtaaaatgtataatgaagctttgccaaccagactgtgctagcaacaaatttttttaaataagctttatgcagtggtaataaggtggcctcaaatatattgtgtctgatggagagttattagtgaaatgaatgtggtctttcttaaggcctgggtggactgtaaactttgccaatagtataactcttgtcttctggccacttgatgtttaaatatctgaaatatcattttgaaaaaaatacatctatatataacatacatgaagagatgctaagctgacagtgatattttagcacatttgaagactgggaagagattttcaggtgaattttaactggtctattcttgcccttagtatctacttcaaattgaagtctacaaacaaagcagttcctttgggaggtttttagtttgagttttagcgtgtgtgtgtgtttgtgtgtgtgcgtgtgcgtgtgtgtttgtgttggaatttcctatctgcctggatatattagcagagtttgaatgtagttttggcctttggccattagacttctattaaaattcattaatagtcatacaaccaacatagagttgaatgagaactgccgatgtaattaataggcatgacatccatttcaaacatctcaacactttaaagaaaagccctttgtttcaagaaaaaagggtttgtaactaactaaatacctaacatgtaattgacactaaaatatgaactttgtcttatttagtttctgttatagctgtaaaatttcaggcagagccataacattgtacagagtgtagcacttgtgattaaacctagcctgttaaatcctgaaaccttcaaccattacttctgtgaatactttagccctgggatttgggtttttctgttccggtgttgtgtctgttgccggcaatggacacaccatatctgctgctggcccaaggaacgtcattaatttttctttccaaattaagtattatgtgctagtcagtgtatagtaaagcacttctcttttttattactaaaaagctggcattagatttgcattataaatacctctctaggaactttatactccttttccttcttcaacaggtattgcccttaaatcttatcttttggccttgaaagtttatagctattgtttttcagttgttcgttgttttgttttgtttcactttagttctgtagtacctgcccattaatatttttgctttgattctagcaatgtgtatgtatctgtataaaaaataaaataatgaaagcaacctaaaaataggatgcaccaata

SEQ ID NO: 702 - DNA, 2540 bp, Homo sapiens
aaacaaaacctggaagcatctcaagtgcctaccagcaggaggatggctacactgccatacgttttcacaatggactatgcataacagtacttccccacagccacacatggcaacgtcaagaagtctctgctgagtggaaaagcaagtctcaaaagattgcacagagtatgctgctcctgtttgttttatatagtgcaaaaacaaccaaaactaaacaaaacattgtttaggcagtcatatatatgtgatcaaactactttcagaaagagcaaagggataataaacataaaattcatttttttttttttttttgagatggagtctcgctctgtcgcccaggctggagtgcagtggcgcaatctcagctcactgcaagctccgcctcccgggttcatgccattatcctgcctcagcctcctgagtagctgggactataagcgcccaccaccatgcccggcgaatttttttgtatttttagtagagacagggtttcaccgtgttagccaggatggtctcgatctcctgaccttgtgatctgcctgcctcgacctcccaaagtgctgggattacaggtgtgagccaccacgcctggcacataaaattcaaaccagaggttacctggagggagagaggcagggaggagcacgtggatagacatatattcagattattagatatcaggtttacagatactcattttattaagaaggaattaatgaataaaacacagagagaaaagagggtcacgcatctaccaaatatgacatgaagggttttgattagctaaaaatggacagtcaagaaggcagagggtcaaaagatgtagatggccatcagttaaaaagacaggcactcaggtccagctctaggaagagaaataaactaacagatacctatgcaggcattggcaaagcaaagagactttcctttcctttgttgagctgaaggcgagggtggtgaattcctgtttgtttttggatccctgccttgcctcacaccaggacccagtgtgtggtcccacgtccttagatacgtatgcctggtcagggtactagtctcaattaaaagcaactgcaacatcagtcccaatccatagtgcccacggccaacatagaggctgagggtgaagctaagaagaaaaagaggcgcgagctaaccctaaagagcacagtggcactcctccgtggcctctgctccaacccaggtgtgctccgcgaggccacaggtgagactccccagaggcccgttcctaatggggtctacaaagaatgcacaagggaggctcagagacatttacagttaggctcaaaataaccgtgagggccagctgtgccttccagccgagccacctccaaaattctaggtgggaccatggatagcgcagcttgctacagcccagctaacttctccagggaaagtgagggtgggaaaaaataaatcacaaatatttactgttggccaggcacagtggctcaagcctggaatccaagcaccttgggagggcaaggtgggaggatcccttgaacccagctgtttgagaccagcctgagcaacagagagactctatctctacaaaaaaaaatttaaaaattagctgggcgtggtggcttgaacctgtggtcccaactacttgggaggctgaggtggggggatcgcttgagcccacgaagccaaaggctgcagtgagccatgatcataccactgcactccagccttggtggcagagtaagagcctgtctcaaaaaataaaataaaataaaaatatatttattgttgctttaaaaagcagaaacaggctgggtgtggtggctcacacctgtaaccccagcactttgggaggccaaggtgggaagattgcttgagcctcagaggttgagaccagcccgggcaacatggtgaaaccccatctctaataaaaatacaaaaattagtgcttcctccagtccgtgcctccaatatgatgaaaaaaagaaggaacaacggtcgtaccaaaaagggccgcggccacgtgcagcctatttgcgacacgaactgtgcccaatgtgtgcccaaggacaaggctattaacaaattcatcattggaaacacagtggaggctgcagcagtcagggacatttctgaagcgagcgtctttgatgcctatgtgcttcccaagctgtatttgaagctacattactgtctgagttgtgcaattcacagcaaagtagtcaggaatcgatcttgtgaagcccacaaggactgaacacccctactccaatttagacctgcggatgctgccccacaacccccaccaaagcccacgtaaggagttgagtccttaaagtctgaagacggactattctcttgagaaaaataaaatggaaattgtacttaattaaaaaatacaaaaagtagccatgagtggtgacatgcacctgtggtcccagctacacgcaggggctgaagtgtgaggatcacctgagcttggggggttgagactgcagtaaactgagatcacatcactgcactccagcctgggtgacagagtaaaaccttgtctc

SEQ ID NO: 703 - protein, 15 aa, Homo sapiens
GENYCFSVQAVIPSR

SEQ ID NO: 704 - protein, 17 aa, Homo sapiens
CFYTTDTECDLTDEIVK

SEQ ID NO: 705 - protein, 13 aa, Homo sapiens
STDSPVECMGQEK

SEQ ID NO: 706 - protein, 9 aa, Homo sapiens
DTEITCSER

SEQ ID NO: 707 - protein, 8 aa, Homo sapiens
GLEAICAK

SEQ ID NO: 708 - protein, 16 aa, Homo sapiens
DKLPQPVQPDPVSHCK

SEQ ID NO: 709 - protein, 7 aa, Homo sapiens
EVTVECK

SEQ ID NO: 710 - protein, 6 aa, Homo sapiens
IDCVSK

SEQ ID NO: 711 - protein, 19 aa, Homo sapiens
CFLAGNNFSPTVNLELPLR

SEQ ID NO: 712 - protein, 18 aa, Homo sapiens
NPMDYPVEDAFCKPQLVK

SEQ ID NO: 713 - protein, 7 aa, Homo sapiens
LLEADCR

SEQ ID NO: 714 - protein, 8 aa, Homo sapiens
DLLNCSFK

SEQ ID NO: 715 - protein, 9 aa, Homo sapiens
YNFFCQGTR

SEQ ID NO: 716 - protein, 7 aa, Homo sapiens
SLACQGK

SEQ ID NO: 717 - protein, 9 aa, Homo sapiens
DNWVFCGGK

SEQ ID NO: 718 - protein, 12 aa, Homo sapiens
TYILTCEHDVLR

SEQ ID NO: 719 - protein, 27 aa, Homo sapiens
ICISGDSAGGNLAAALGQQFTQDASLK

SEQ ID NO: 720 - protein, 10 aa, Homo sapiens
CLCAIDIHNK

SEQ ID NO: 721 - protein, 9 aa, Homo sapiens
ESVVDYCNR

SEQ ID NO: 722 - protein, 9 aa, Homo sapiens
AVDCLLDSK

SEQ ID NO: 723 - protein, 10 aa, Homo sapiens
CETQNPVSAR

SEQ ID NO: 724 - protein, 17 aa, Homo sapiens
YIFITGCDSGFGNLAAR

SEQ ID NO: 725 - protein, 6 aa, Homo sapiens
FENCNK

SEQ ID NO: 726 - protein, 16 aa, Homo sapiens
YLEGTSCIAGVLVPAK

SEQ ID NO: 727 - protein, 7 aa, Homo sapiens
TMLQCLK

SEQ ID NO: 728 - protein, 8 aa, Homo sapiens
LAEEESCR

SEQ ID NO: 729 - protein, 9 aa, Homo sapiens
TVVALCGQR

SEQ ID NO: 730 - protein, 10 aa, Homo sapiens
CVEENNGVAK

SEQ ID NO: 731 - protein, 5 aa, Homo sapiens
TECER

SEQ ID NO: 732 - protein, 11 aa, Homo sapiens
NLSGQPNFPCR

SEQ ID NO: 733 - protein, 17 aa, Homo sapiens
FKDDVMPATYCEIDLDK

SEQ ID NO: 734 - protein, 7 aa, Homo sapiens
IFQALCK

SEQ ID NO: 735 - protein, 11 aa, Homo sapiens
SETVLTCATGR

SEQ ID NO: 736 - protein, 7 aa, Homo sapiens
VLVCAHR

SEQ ID NO: 737 - protein, 13 aa, Homo sapiens
GHCVDLPDTGLCK

SEQ ID NO: 738 - protein, 10 aa, Homo sapiens
SIHDFCLVSK

SEQ ID NO: 739 - protein, 5 aa, Homo sapiens
CLLLK

SEQ ID NO: 740 - protein, 8 aa, Homo sapiens
CSVLFHLR

SEQ ID NO: 741 - protein, 8 aa, Homo sapiens
TAAVCVAK

SEQ ID NO: 742 - protein, 8 aa, Homo sapiens
FLTVLCSR

SEQ ID NO: 743 - protein, 11 aa, Homo sapiens
GGDEYDNHCGK

SEQ ID NO: 744 - protein, 10 aa, Homo sapiens
TFEVCDLPVR

SEQ ID NO: 745 - protein, 8 aa, Homo sapiens
SCAGISGK

SEQ ID NO: 746 - protein, 13 aa, Homo sapiens
DEVLYVFPSDFCR

SEQ ID NO: 747 - protein, 13 aa, Homo sapiens
CTTSILHNLSHHR

SEQ ID NO: 748 - protein, 23 aa, Homo sapiens
VLSVCPSNKPAIVEAGGMQALGK

SEQ ID NO: 749 - protein, 6 aa, Homo sapiens
DVSCSR

SEQ ID NO: 750 - protein, 8 aa, Homo sapiens
LLFVPCSR

SEQ ID NO: 751 - protein, 7 aa, Homo sapiens
ITEFCHR

SEQ ID NO: 752 - protein, 13 aa, Homo sapiens
FIITALPTIYHCK

SEQ ID NO: 753 - protein, 7 aa, Homo sapiens
CIDVHLK

SEQ ID NO: 754 - protein, 6 aa, Homo sapiens
ILTCPK

SEQ ID NO: 755 - protein, 10 aa, Homo sapiens
NQCTQVVQER

SEQ ID NO: 756 - protein, 19 aa, Homo sapiens
LLEAQACTGGIIHPTTGQK

SEQ ID NO: 757 - protein, 9 aa, Homo sapiens
YQAECSQFK

SEQ ID NO: 758 - protein, 7 aa, Homo sapiens
DILIACR

SEQ ID NO: 759 - protein, 12 aa, Homo sapiens
CVANNQVETLEK

SEQ ID NO: 760 - protein, 7 aa, Homo sapiens
IHDVLCK

SEQ ID NO: 761 - protein, 13 aa, Homo sapiens
VEGCFNQLLYDIR

SEQ ID NO: 762 - protein, 7 aa, Homo sapiens
SCEVPTR

SEQ ID NO: 763 - protein, 7 aa, Homo sapiens
CEESFVK

SEQ ID NO: 764 - protein, 7 aa, Homo sapiens
DSVICLK

SEQ ID NO: 765 - protein, 8 aa, Homo sapiens
LTCLQNLK

SEQ ID NO: 766 - protein, 9 aa, Homo sapiens
WSTAVEFCK

SEQ ID NO: 767 - protein, 18 aa, Homo sapiens
DCGLPPDVPNAQPALEGR

SEQ ID NO: 768 - protein, 19 aa, Homo sapiens
EIYCPAPPQIDNGIIQGER

SEQ ID NO: 769 - protein, 9 aa, Homo sapiens
ATVMFECDK

SEQ ID NO: 770 - protein, 8 aa, Homo sapiens
VLCTPPPK

SEQ ID NO: 771 - protein, 7 aa, Homo sapiens
SCPDAIK

SEQ ID NO: 772 - protein, 13 aa, Homo sapiens
LCSGVLGTVVHGK

SEQ ID NO: 773 - protein, 21 aa, Homo sapiens
QVCQLPGLFSYAQHIASIDGR

SEQ ID NO: 774 - protein, 8 aa, Homo sapiens
ETCISFIK

SEQ ID NO: 775 - protein, 7 aa, Homo sapiens
CSLIDKK

SEQ ID NO: 776 - protein, 19 aa, Homo sapiens
FVCMLVTEDNVFEAPTIVK

SEQ ID NO: 777 - protein, 6 aa, Homo sapiens
LLLCAR

SEQ ID NO: 778 - protein, 13 aa, Homo sapiens
SEGTYCCGPVPVR

SEQ ID NO: 779 - protein, 10 aa, Homo sapiens
DCLTESNLIK

SEQ ID NO: 780 - protein, 18 aa, Homo sapiens
VVSGMVNCNDDQGVLLGR

SEQ ID NO: 781 - protein, 7 aa, Homo sapiens
CLGIPTR

SEQ ID NO: 782 - protein, 10 aa, Homo sapiens
CDLELETNGR

SEQ ID NO: 783 - protein, 13 aa, Homo sapiens
EYLPIGGLAEFCK

SEQ ID NO: 784 - protein, 7 aa, Homo sapiens
IAGLCNR

SEQ ID NO: 785 - protein, 9 aa, Homo sapiens
LIIVEGCQR

SEQ ID NO: 786 - protein, 8 aa, Homo sapiens
GLGDCLVK

SEQ ID NO: 787 - protein, 9 aa, Homo sapiens
YLAICHPFK

SEQ ID NO: 788 - protein, 6 aa, Homo sapiens
FENLCK

SEQ ID NO: 789 - protein, 7 aa, Homo sapiens
YIQAACK

SEQ ID NO: 790 - protein, 5 aa, Homo sapiens
FICIR

SEQ ID NO: 791 - protein, 13 aa, Homo sapiens
HSSLAGCQIINYR

SEQ ID NO: 792 - protein, 6 aa, Homo sapiens
VEECQR

SEQ ID NO: 793 - protein, 9 aa, Homo sapiens
LQLEACETR

SEQ ID NO: 794 - protein, 6 aa, Homo sapiens
LECLQR

SEQ ID NO: 795 - protein, 17 aa, Homo sapiens
FLEGTSCIAGVFVDATK

SEQ ID NO: 796 - protein, 15 aa, Homo sapiens
CITDPQTGLCLLPLK

SEQ ID NO: 797 - protein, 7 aa, Homo sapiens
LCFEGLR

SEQ ID NO: 798 - protein, 18 aa, Homo sapiens
TLLQGSGCLAGIYLEDTK

SEQ ID NO: 799 - protein, 9 aa, Homo sapiens
VPLDVACAR

SEQ ID NO: 800 - protein, 10 aa, Homo sapiens
CVEDPETGLR

SEQ ID NO: 801 - protein, 12 aa, Homo sapiens
AYLDATCVEWLR

SEQ ID NO: 802 - protein, 12 aa, Homo sapiens
AYLEGTCVEWLR

SEQ ID NO: 803 - protein, 12 aa, Homo sapiens
TYLEGTCVEWLR

SEQ ID NO: 804 - protein, 8 aa, Homo sapiens
ELYENFCK

SEQ ID NO: 805 - protein, 8 aa, Homo sapiens
CGEMLHIR

SEQ ID NO: 806 - protein, 8 aa, Homo sapiens
GTAVAICR

SEQ ID NO: 807 - protein, 15 aa, Homo sapiens
VGEATETALTCLVEK

SEQ ID NO: 808 - protein, 6 aa, Homo sapiens
FACFER

SEQ ID NO: 809 - protein, 9 aa, Homo sapiens
CSSILLHGK

SEQ ID NO: 810 - protein, 10 aa, Homo sapiens
ACVVHGSDLK

SEQ ID NO: 811 - protein, 8 aa, Homo sapiens
ECVQPATK

SEQ ID NO: 812 - protein, 9 aa, Homo sapiens
ANACNSVIK

SEQ ID NO: 813 - protein, 7 aa, Homo sapiens
DACLNAR

SEQ ID NO: 814 - protein, 12 aa, Homo sapiens
DACVISSDFHER

SEQ ID NO: 815 - protein, 6 aa, Homo sapiens
LIICVK

SEQ ID NO: 816 - protein, 12 aa, Homo sapiens
MAFPCFDEPLFK

SEQ ID NO: 817 - protein, 15 aa, Homo sapiens
LSAPGCWAACTNFSR

SEQ ID NO: 818 - protein, 10 aa, Homo sapiens
ALSIGFETCR

SEQ ID NO: 819 - protein, 8 aa, Homo sapiens
TEAADLCK

SEQ ID NO: 820 - protein, 16 aa, Homo sapiens
HHPTTLAVGICSPASR

SEQ ID NO: 821 - protein, 13 aa, Homo sapiens
CHLDTTGTYTQYR

SEQ ID NO: 822 - protein, 13 aa, Homo sapiens
LCLISTFLEDGIR

SEQ ID NO: 823 - protein, 12 aa, Homo sapiens
FEHCNFNDVTTR

SEQ ID NO: 824 - protein, 12 aa, Homo sapiens
DSNNLCLHFNPR

SEQ ID NO: 825 - protein, 9 aa, Homo sapiens
ACLENLGLK

SEQ ID NO: 826 - protein, 15 aa, Homo sapiens
IATGHNIIDELPPCK

SEQ ID NO: 827 - protein, 7 aa, Homo sapiens
LISLICR

SEQ ID NO: 828 - protein, 12 aa, Homo sapiens
CEDLETQTQSEK

SEQ ID NO: 829 - protein, 9 aa, Homo sapiens
LLCGLLAER

SEQ ID NO: 830 - protein, 7 aa, Homo sapiens
LDVLCTK

SEQ ID NO: 831 - protein, 13 aa, Homo sapiens
TIVYLDGSSQSCR

SEQ ID NO: 832 - protein, 6 aa, Homo sapiens
EGCVEK

SEQ ID NO: 833 - protein, 7 aa, Homo sapiens
TICIAYR

SEQ ID NO: 834 - protein, 6 aa, Homo sapiens
VTLTCK

SEQ ID NO: 835 - protein, 11 aa, Homo sapiens
NILVNSNLVCK

SEQ ID NO: 836 - protein, 7 aa, Homo sapiens
CGQYIQK

SEQ ID NO: 837 - protein, 15 aa, Homo sapiens
DSFSDPYAHICFLHR

SEQ ID NO: 838 - protein, 7 aa, Homo sapiens
FPSVCEK

SEQ ID NO: 839 - protein, 20 aa, Homo sapiens
HSATTVFGANTPIVSCNFDR

SEQ ID NO: 840 - protein, 9 aa, Homo sapiens
KVCTNIIEK

SEQ ID NO: 841 - protein, 6 aa, Homo sapiens
ICFLHR

SEQ ID NO: 842 - protein, 9 aa, Homo sapiens
VHVCGQTHR

SEQ ID NO: 843 - protein, 9 aa, Homo sapiens
ADCLMGEFK

SEQ ID NO: 844 - protein, 13 aa, Homo sapiens
ELPDSVPQECTVR

SEQ ID NO: 845 - protein, 11 aa, Homo sapiens
KPVVGQCTIER

SEQ ID NO: 846 - protein, 12 aa, Homo sapiens
MYELSCYLPQEK

SEQ ID NO: 847 - protein, 10 aa, Homo sapiens
ASLLSAPPCR

SEQ ID NO: 848 - protein, 20 aa, Homo sapiens
NFQMASITSPSLVVECGGER

SEQ ID NO: 849 - protein, 20 aa, Homo sapiens
FGSHCGIPEEYCVSGVNTWR

SEQ ID NO: 850 - protein, 9 aa, Homo sapiens
GWWPCYAEK

SEQ ID NO: 851 - protein, 19 aa, Homo sapiens
LDLPNRPETSFLWFTNPCK

SEQ ID NO: 852 - protein, 9 aa, Homo sapiens
FHLCSVPTR

SEQ ID NO: 853 - protein, 20 aa, Homo sapiens
FCVSDTENNLGFALGPMFVK

SEQ ID NO: 854 - protein, 7 aa, Homo sapiens
ANSEACR

SEQ ID NO: 855 - protein, 6 aa, Homo sapiens
AVMECR

SEQ ID NO: 856 - protein, 9 aa, Homo sapiens
LHIVQVVCK

SEQ ID NO: 857 - protein, 11 aa, Homo sapiens
SFLIEIQCISR

SEQ ID NO: 858 - protein, 12 aa, Homo sapiens
SAFPCFDEPAFK

SEQ ID NO: 859 - protein, 7 aa, Homo sapiens
VTCEPQK

SEQ ID NO: 860 - protein, 17 aa, Homo sapiens
AVLVTGGDCGLGHALCK

SEQ ID NO: 861 - protein, 6 aa, Homo sapiens
LCFLDK

SEQ ID NO: 862 - protein, 13 aa, Homo sapiens
GLAPAEISAVCEK

SEQ ID NO: 863 - protein, 10 aa, Homo sapiens
ALQAQEIECR

SEQ ID NO: 864 - protein, 10 aa, Homo sapiens
IHAPWNVLCR

SEQ ID NO: 865 - protein, 7 aa, Homo sapiens
CLAPSPK

SEQ ID NO: 866 - protein, 6 aa, Homo sapiens
IFCTAK

SEQ ID NO: 867 - protein, 6 aa, Homo sapiens
SQQLCK

SEQ ID NO: 868 - protein, 6 aa, Homo sapiens
YVCLVR

SEQ ID NO: 869 - protein, 7 aa, Homo sapiens
VYCLKMR

SEQ ID NO: 870 - protein, 6 aa, Homo sapiens
YIDLCR

SEQ ID NO: 871 - protein, 7 aa, Homo sapiens
AICITYK

SEQ ID NO: 872 - protein, 9 aa, Homo sapiens
YIAICHPFK

SEQ ID NO: 873 - protein, 9 aa, Homo sapiens
CSSILIHGK

SEQ ID NO: 874 - DNA, 31 bp, Homo sapiens
ggggacaagtttgtacaaaaaagcaggcttc

SEQ ID NO: 875 - DNA, 29 bp, Homo sapiens
ggggaccactttgtacaagaaagctgggt

---

The invention claimed is:

1. A method of diagnosing pancreatic cancer in an individual, the method comprising detecting a higher level of ASCT2 protein in a sample from the individual as compared to levels of ASCT2 protein in pancreatic tissues of healthy individuals, wherein the amino acid sequence of the ASCT2 protein comprises SEQ ID NO:56, and wherein the higher level of ASCT2 protein indicates that said individual has pancreatic cancer.

2. The method of claim 1, wherein the ASCT2 protein is detected by contacting the sample with an isolated antibody that selectively binds to the ASCT2 protein and determining the extent or binding of the antibody to the ASCT2 protein.

3. The method of claim 2, wherein the antibody is coupled to a detectable substance.

* * * * *

UNITED STATES PATENT AND TRADEMARK OFFICE
CERTIFICATE OF CORRECTION

PATENT NO. : 7,473,531 B1 Page 1 of 1
APPLICATION NO. : 10/912745
DATED : January 6, 2009
INVENTOR(S) : Bruno Domon et al.

It is certified that error appears in the above-identified patent and that said Letters Patent is hereby corrected as shown below:

On the title page item (73), the name of the Assignee is listed as "Colora Corporation", but it should read "Celera Corporation".

Signed and Sealed this

Ninth Day of June, 2009

JOHN DOLL
*Acting Director of the United States Patent and Trademark Office*

UNITED STATES PATENT AND TRADEMARK OFFICE
CERTIFICATE OF CORRECTION

PATENT NO.       : 7,473,531 B1
APPLICATION NO.  : 10/912745
DATED            : January 6, 2009
INVENTOR(S)      : Domon et al.

Page 1 of 1

It is certified that error appears in the above-identified patent and that said Letters Patent is hereby corrected as shown below:

In the Specification:

In Columns 3 and 4, please insert the following page-wide *LENGTHY TABLES* statement so that it immediately precedes the heading *DESCRIPTION OF FIGURES*.

LENGTHY TABLES

The patent contains a lengthy table section. A copy of the table is available in electronic form from the USPTO web site (htpp://seqdata.uspto.gov/?pageRequest=docDetail&DocID=US07473531B1). An electronic copy of the table will be also be available from the USPTO upon request and payment of the fee set forth in 37 CFR 1.19(b)(3).

Signed and Sealed this

Twenty-first Day of July, 2009

JOHN DOLL
*Acting Director of the United States Patent and Trademark Office*